(12) United States Patent
Steyaert et al.

(10) Patent No.: US 11,873,347 B2
(45) Date of Patent: Jan. 16, 2024

(54) ANTIGEN-BINDING CHIMERIC PROTEINS AND METHODS AND USES THEREOF

(71) Applicants: VIB VZW, Ghent (BE); VRIJE UNIVERSITEIT BRUSSEL, Brussels (BE)

(72) Inventors: Jan Steyaert, Beersel (BE); Els Pardon, Wezemaal (BE); Tomasz Uchanski, Libramont-Chevigny (BE); Wim Vranken, Brussels (BE)

(73) Assignees: VIB VZW, Ghent (BE); VRIJ UNIVERSITEIT BRUSSEL, Brussels (BE)

( * ) Notice: Subject to any disclaimer, the term of this patent is extended or adjusted under 35 U.S.C. 154(b) by 677 days.

(21) Appl. No.: 16/760,394

(22) PCT Filed: Oct. 31, 2018

(86) PCT No.: PCT/EP2018/079891
§ 371 (c)(1),
(2) Date: Apr. 29, 2020

(87) PCT Pub. No.: WO2019/086548
PCT Pub. Date: May 9, 2019

(65) Prior Publication Data
US 2021/0206880 A1 Jul. 8, 2021

(30) Foreign Application Priority Data

Oct. 31, 2017 (EP) .................................... 17199472
Oct. 10, 2018 (EP) .................................... 18199709

(51) Int. Cl.
| | |
|---|---|
| *C07K 16/46* | (2006.01) |
| *C07K 14/195* | (2006.01) |
| *G01N 23/20* | (2018.01) |
| *G01N 33/68* | (2006.01) |
| *C07K 14/705* | (2006.01) |
| *C07K 14/005* | (2006.01) |
| *C12N 7/00* | (2006.01) |

(52) U.S. Cl.
CPC .......... *C07K 16/465* (2013.01); *C07K 14/005* (2013.01); *C07K 14/195* (2013.01); *C07K 14/705* (2013.01); *C12N 7/00* (2013.01); *G01N 23/20* (2013.01); *G01N 33/6845* (2013.01); *C07K 2299/00* (2013.01); *C07K 2317/569* (2013.01); *C07K 2319/03* (2013.01); *C12N 2795/00022* (2013.01); *C12N 2795/00023* (2013.01)

(58) Field of Classification Search
CPC .. C07K 16/46; C07K 16/468; C07K 2317/62; C07K 2317/22; C07K 2299/00; C07K 14/705; G01N 33/6845; G01N 23/20
See application file for complete search history.

(56) References Cited

FOREIGN PATENT DOCUMENTS

WO 9749805 A2 12/1997

OTHER PUBLICATIONS

Koide, Shohei. "Engineering of Recombinant Crystallization Chaperones." Current Opinion in Structural Biology, vol. 19, No. 4, 2009, pp. 449-457.
Manglik, Aashish, et al. "Nanobodies to Study G Protein-Coupled Receptor Structure and Function." Annual Review of Pharmacology and Toxicology, vol. 57, No. 1, 2017, pp. 19-37.
PCT International Search Report and Written Opinion; Application No. PCT/EP2018/079891 VIB VZW, International filing date of Oct. 31, 2018, dated Jan. 3, 2019, 11 pages.
Zhang, Yong, et al. "Rational Design of Humanized Dual-Agonist Antibodies." vol. 137, No. 1, 2015, pp. 38-41.

*Primary Examiner* — Ruixiang Li
(74) *Attorney, Agent, or Firm* — Patent Law Works LLP

(57) ABSTRACT

The present invention relates to the field of structural biology. More specifically, the present invention relates to novel antigen-binding chimeric proteins, their uses and methods in three-dimensional structural analysis of macromolecules, such as X-ray crystallography and high-resolution Cryo-EM, and their use as a therapeutic, diagnostic, or imaging tool. Even more specifically, the invention relates to a fusion of a scaffold protein and an antigen-binding domain wherein the scaffold protein of said fusion interrupts the Immunoglobulin domain topology to form a rigid chimer.

22 Claims, 41 Drawing Sheets
(23 of 41 Drawing Sheet(s) Filed in Color)
Specification includes a Sequence Listing.

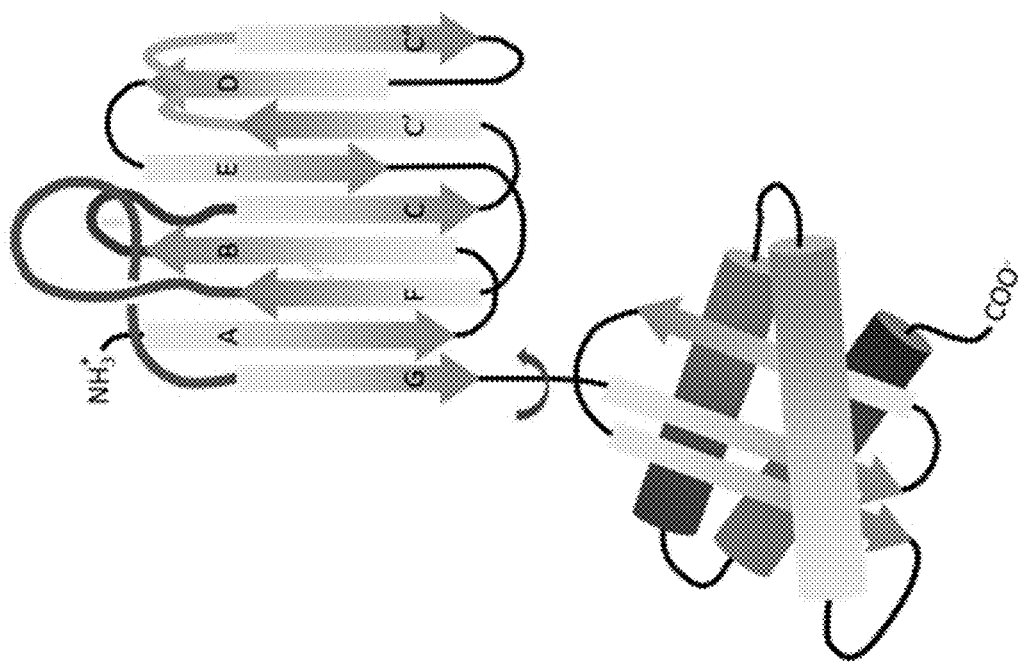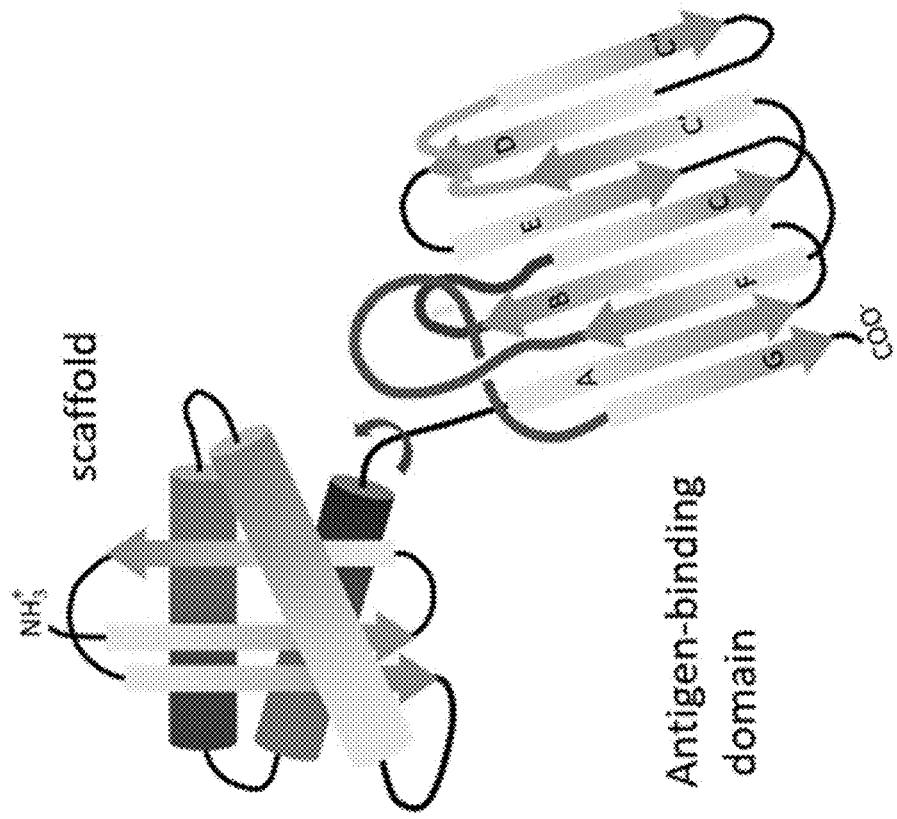
FIG. 1A

FIG. 1B
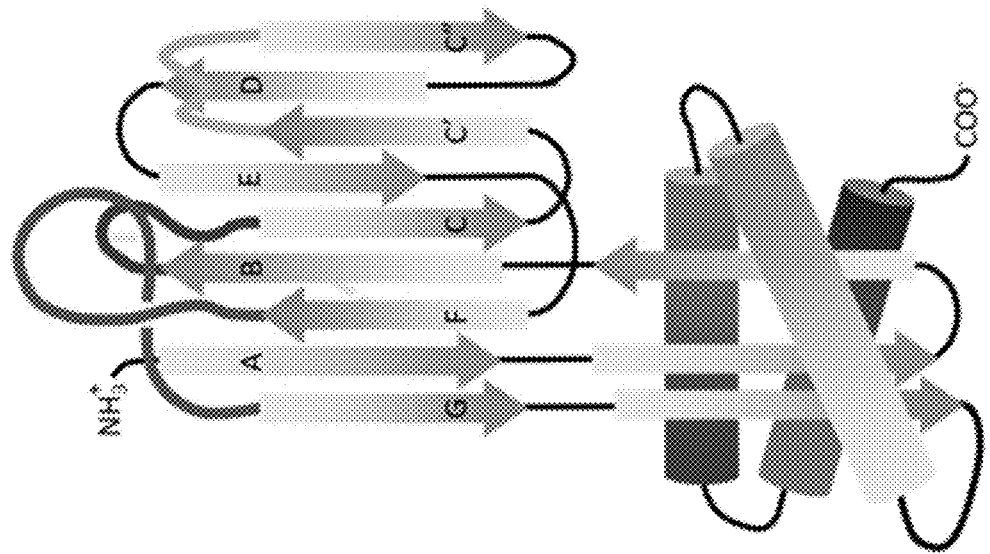
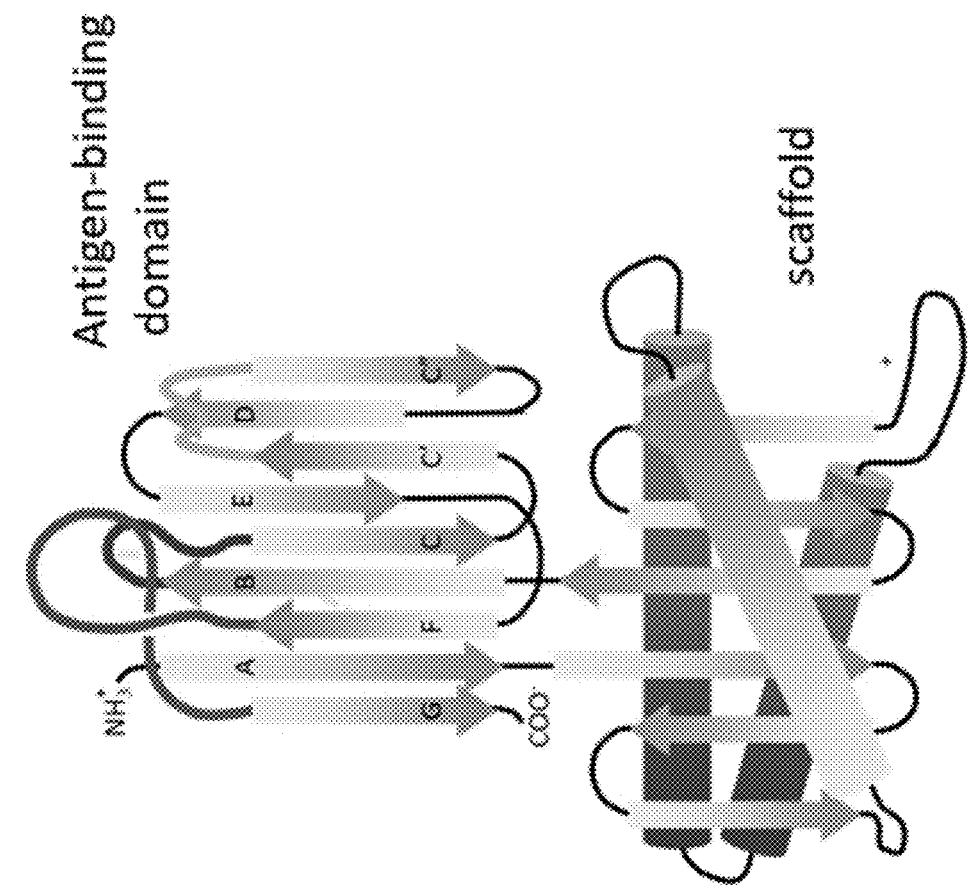

Figure 7

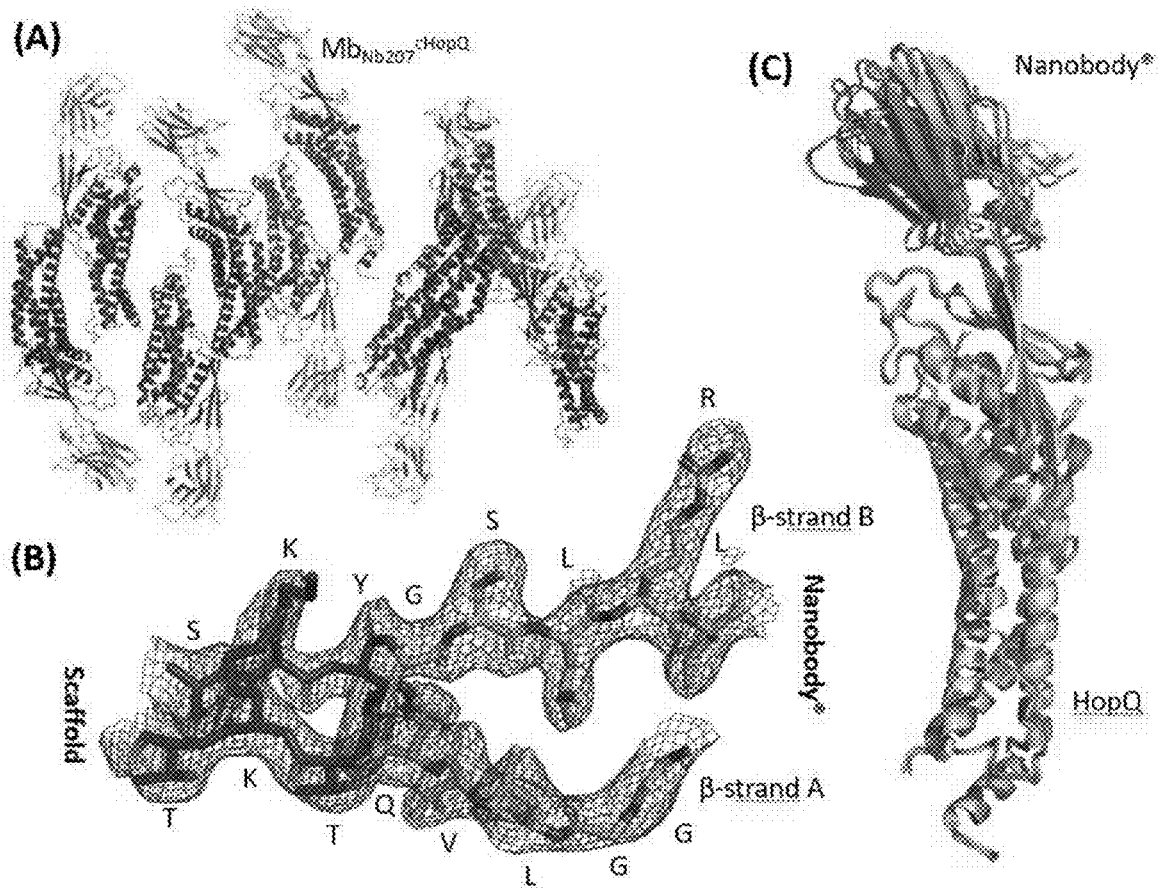

Figure 8

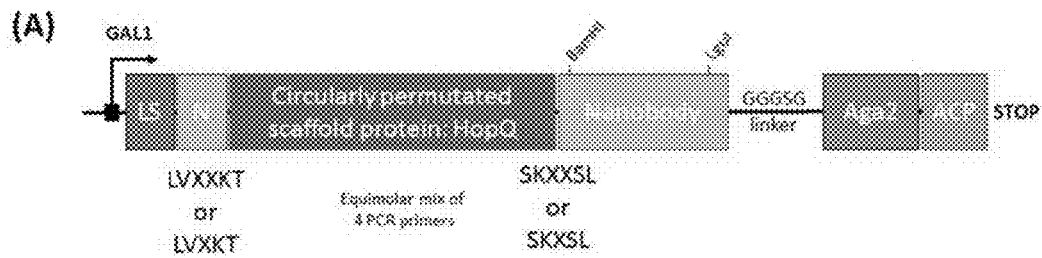

(B) MRFPSIFTAVVFAASSALAAPANTTAEDETAQIPAEAVIGYLGLEGDSDVAALPLSDSTNNGSLSTNTTIASIAAKEEGVQLDKREAE
AQVQLVESGGGLV(X)₄KTTTSVIDTTNDAQNLLTQAQTIVNTLKDYCPIJAKSSSSNGGTNNANTPSWQTAGGGKNSCATFG
AEFSAASDMINNAQKIVQETQQLSANQPKNITQPHNLNLNSPSSLTALAQKMLKNAQSQAEILKLANQVESDFNKLSSGHLK
DYIGKCDASAISSANMTMQNQKNNWGNGCAGVEETQSLLKTSAADFNNQTPQINQAQNLANTLIQELGNNPFRASGGGS
GGGGSGKLSDTYEQLSRLLTNDNGTNSKTSAQAINQAVNNLNERAKTLAGGTTNSPAYQATLLALRSVLGLWNSMGYAVICG
GYTKSPGENNQKDFHYTDENGNGTTINCGGSTNSNGTHSYNGTNTLKADKNVSLSIEQYEKIHEAYQILSKALKQAGLAPLNSR
GERKLEAHVTTSK(X)₄SLRLSCAASGRTFSTAAMGWFRQAPGKEREDFVAGIYWTVGSTYYADSAKGRFTISRDNAKNTVYLQ
MDSLKPEDTAVYYCAARRBGFTLAPTRANEYDYWGQGTQVTVSSiggggsggggsggggsggggsggggsQELITTICL
QIPSPTLESTPYSLSTTTILANGKAMCGVTEYYKSSYTFVSNCGSHPSTTSKGSPINTQYVTKdnsssMSTIEERVEKIIGEQLGVKQEE
VTNNASFVEQLGADSLDTVELVMALEFFFDTEIPDEEAEKITTVQAAIDYINGHIQAseqkliseedl (C)  25%  LVXXKT + SKXXSL  160.000
     25%  LVXXKT + SKXSL   8000
     25%  LVXKT + SKXXSL   8000
     25%  LVXKT + SKXSL    8000
                          184.000 AA-sequence variants

Figure 9

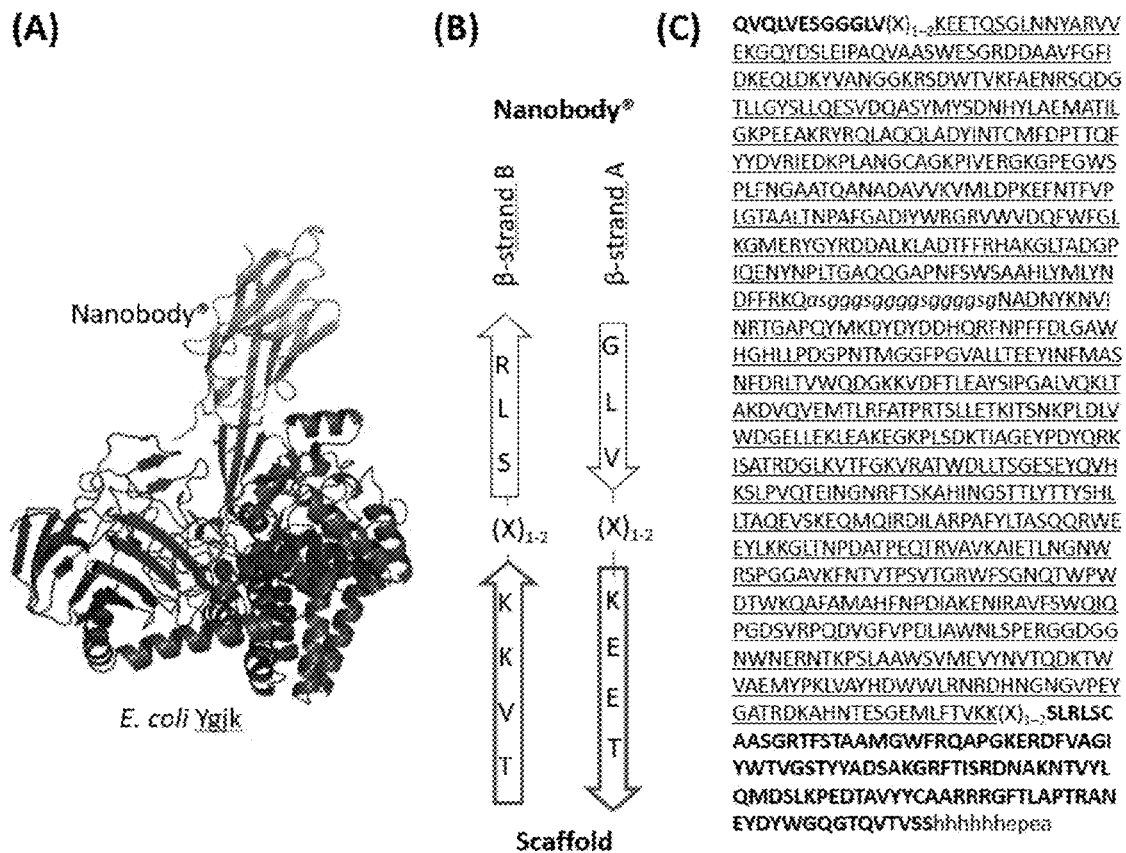

(C) QVQLVESGGGLV(X)₁₋₂KEETQSGLNNYARVV
EKGQYDSLEIPAQVAASWESGRDDAAVFGFI
DKEQLDKYVANGGKRSDWTVKFAENRSQDG
TLLGYSLLQESVDQASYMYSDNHYLAEMATIL
GKPEEAKRYRQLAQQLADYINTCMFDPTTQF
YYDVRIEDKPLANGCAGKPIVERGKGPEGWS
PLFNGAATQANADAVVKVMLDPKEFNTFVP
LGTAALTNPAFGADIYWRGRVWVDQFWFGL
KGMERYGYRDDALKLADTFFRHAKGLTADGP
IQENYNPLTGAQQGAPNFSWSAAHLYMLYN
DFFRKQasgggsggggsggggsgNADNYKNVI
NRTGAPQYMKDYDYDDHQRFNPFFDLGAW
HGHLLPDGPNTMGGFPGVALLTEEYINFMAS
NFDRLTVWQDGKKVDFTLEAYSIPGALVQKLT
AKDVQVEMTLRFATPRTSLLETKITSNKPLDLV
WDGELLEKLEAKEGKPLSDKTIAGEYPDYQRK
ISATRDGLKVTFGKVRATWDLLTSGESEYQVH
KSLPVQTEINGNRFTSKAHINGSTTLYTTYSHL
LTAQEVSKEQMQIRDILARPAFYLTASQQRWE
EYLKKGLINPDATPEQTRVAVKAIETLNGNW
RSPGGAVKFNTVTPSVTGRWFSGNQTWPW
DTWKQAFAMAHFNPDIAKENIRAVESWQIQ
PGDSVRPQDVGFVPDLIAWNLSPERGGDGG
NWNERNTKPSLAAWSVMEVYNVTQDKTW
VAEMYPKLVAYHDWWLRNRDHNGNGVPEY
GATRDKAHNTESGEMLFTVKK(X)₁₋₂SLRLSC
AASGRTFSTAAMGWFRQAPGKERDFVAGI
YWTVGSTYYADSAKGRFTISRDNAKNTVYL
QMDSLKPEDTAVYYCAARRRGFTLAPTRAN
EYDYWGQGTQVTVSShhhhhhepea

Figure 10

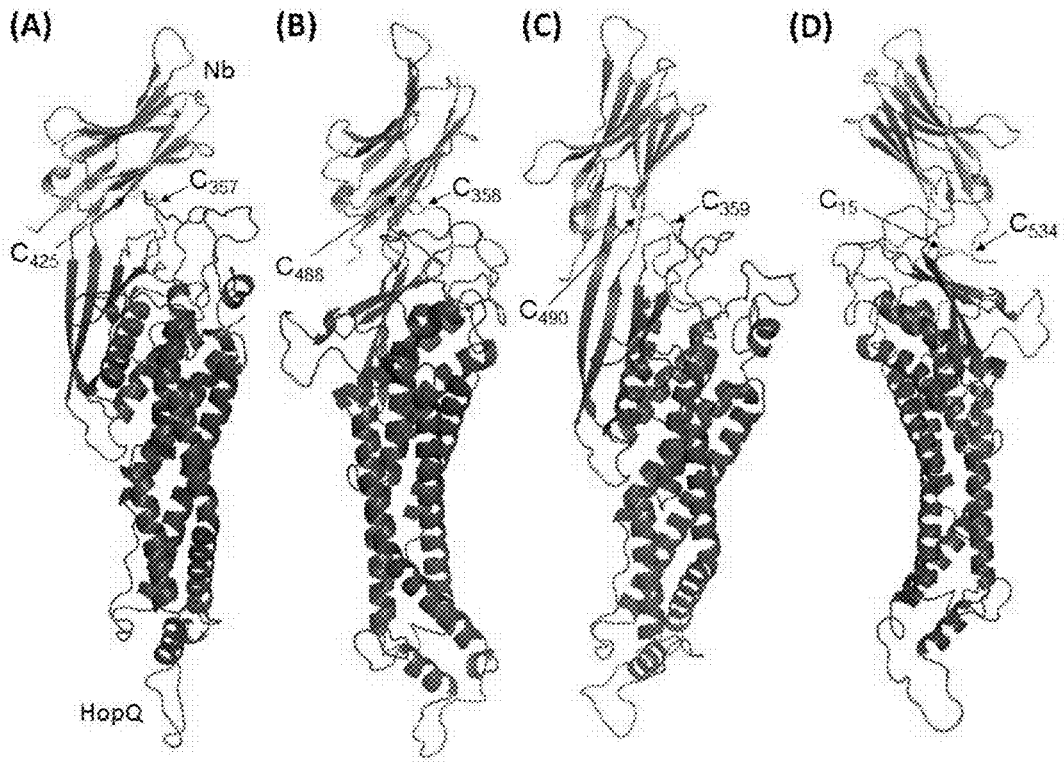

(C) QVQLVESGGGLV(X)₁₋₂CSVDIQGNDQMQFNTNAITV(X)₁₋₂SLRLSCAASGRTFSTAAMGWF
RQAPGKERDFVAGIYWTVGSTYYADSAKGRFTISRDNAKNTVYLQMDSLKPEDTAVYYCAAR
RRGFTLAPTRANEYDYWGQGTQVTVSS(X)₁₋₂VNLSHPGNLPKNVMGHNWVLSTAADMQG
VVTDGMASGLDKDYLKPDDSRVIAHTKLIGSGEKDSVTFDVSKLKEGEQYMFFCTFPGHSALAK
GTLTLKhhhhhhepea

Figure 15

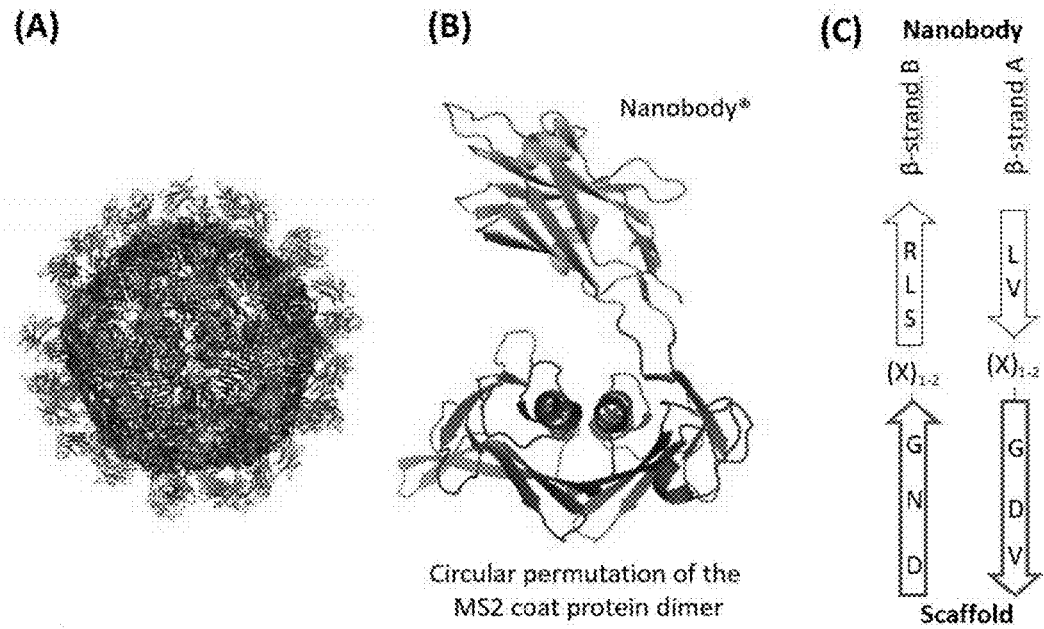

(A)

(B) Nanobody®
Circular permutation of the MS2 coat protein dimer (C) Nanobody
β-strand B | β-strand A
R L S | L V
(X)₁₋₂ | (X)₁₋₂
G N D | G D V
Scaffold (D) MQVQLQESGGGLV(X)₁₋₂GDVTVAPSNFANGVAEWISSNSRSQAYKVTCSVRQSSAQNRKYTIKVEVPKV
ATQTVGGVELPVAAWRSYLNMELTIPIFATNSDCELIVKAMQGLLKDGNPIPSAIAANSGIYASNFTQFVLV
DNGGTGDVTVAPSNFANGVAEWISSNSRSQAYKVTCSVRQSSAQNRKYTIKVEVPKVATQTVGGVELPV
AAWRSYLNMELTIPIFATNSDCELIVKAMQGLLKDGNPIPSAIAANSGIYASNFTQFVLVDNG(X)₁₋₂**SLRLS
CAASGYTIGPYCMGWFRQAPGKEREGVAAINMGGGITYYADSVKGRFTISQDNAKNTVYLLMNSLEP
EDTAIYYCAADSTIYASYYECGHGLSTGGYGYDSWGQGTQVTVSS**hhhhhhepea

Figure 16

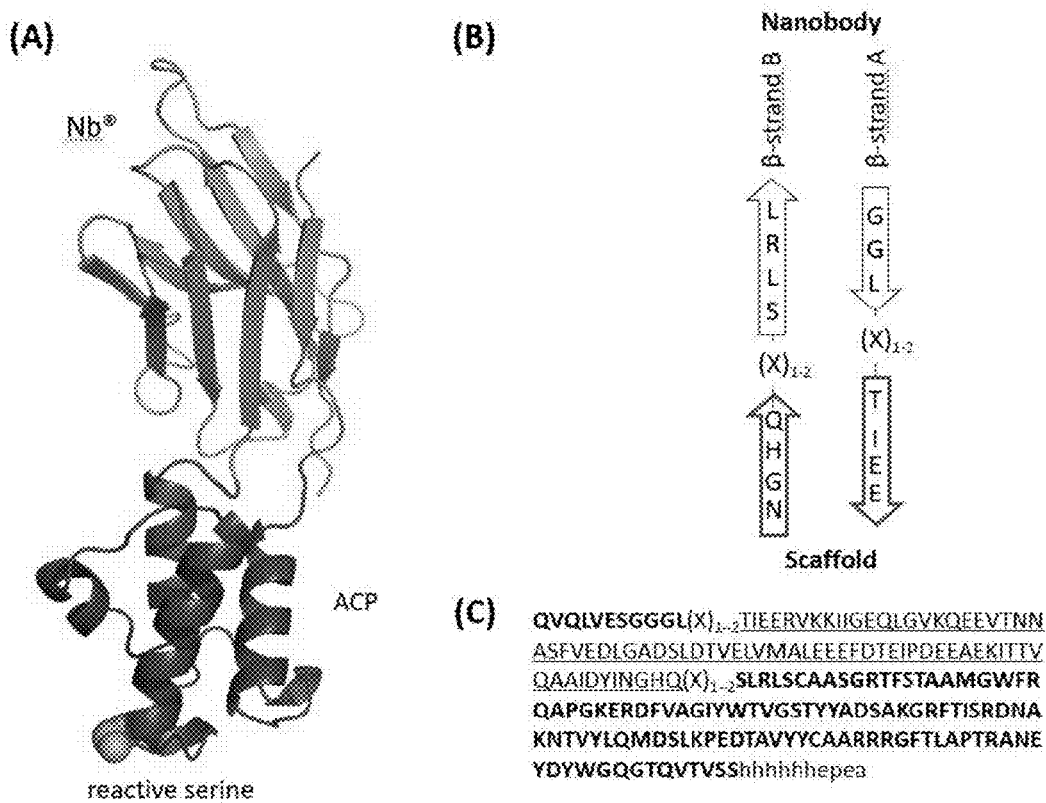

(A) Nb®, ACP, reactive serine (B) Nanobody
β-strand B | β-strand A
L R L S | G G L
(X)₁₋₂ | (X)₁₋₂
Q H G N | T I E E
Scaffold (C) QVQLVESGGGL(X)₁₋₂TIEERVKKIIGEQLGVKQEEVTNN
ASFVEDLGADSLDTVELVMALEEEFDTEIPDEEAEKITTV
QAAIDYINGHQ(X)₁₋₂**SLRLSCAASGRTFSTAAMGWFR
QAPGKERDFVAGIYWTVGSTYYADSAKGRFTISRDNA
KNTVYLQMDSLKPEDTAVYYCAARRRGFTLAPTRANE
YDYWGQGTQVTVSS**hhhhhhepea (C) QVQLVESGGGLVQAGXXXGVQLVESGGGLVQAGGSLRLSCAASGRTFSTAAM
GWFRQAPGKERDFVAGIYWTVGSTYYADSAKGRFTISRDNAKNTVYLQMDS
LKPEDTAVYYCAARRRGFTLAPTRANEYDYWGQXXGSLRLSCAASGYTIGPYC
MGWFRQAPGKEREGVAAINMGGGITYYADSVKGRFTISQDNAKNTVYLLMNS
LEPEDTAIYYCAADSTIYASYYECGHGLSTGGYGYDSWGQGTQVTVSSXXXGQG
TQVTVSShhhhhhepea (C) QVQLVESGGGLVQAGXXXGVQLVESGGGLVQAGGSLRLSCAASGRTFSTAAM
GWFRQAPGKERDFVAGIYWTVGSTYYADSAKGRFTISRDNAKNTVYLQMDS
LKPEDTAVYYCAABRRGFTLAPTRANEYDYWGQXXGSLRLSCAASGYTYSSNC
MAWFRQVPGKEREGVASINTRGGITYYADSVKGRFTISRDNAKNTVSLQMNSL
KPEDTATYYCAAVREATYSDNRCSVRSYTYDYWGQGTQVTVSSXXXGQGTQVT
VSShhhhhhepea Figure 24 continued
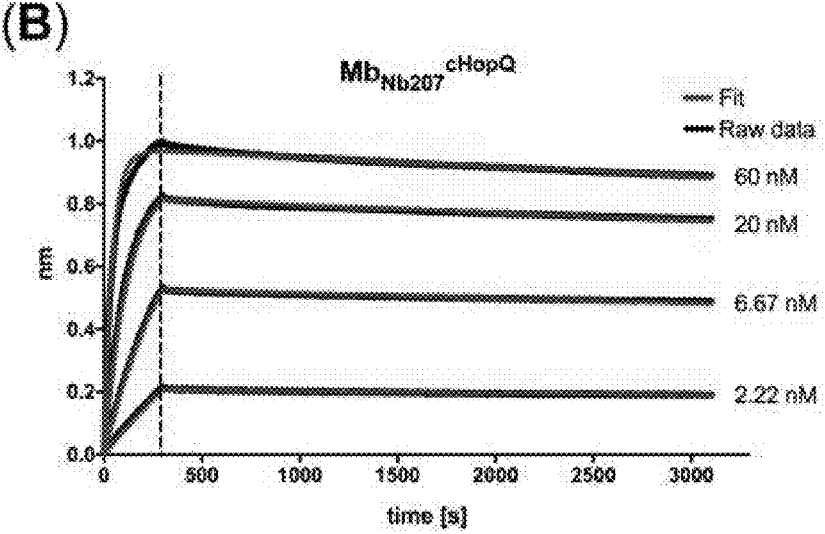
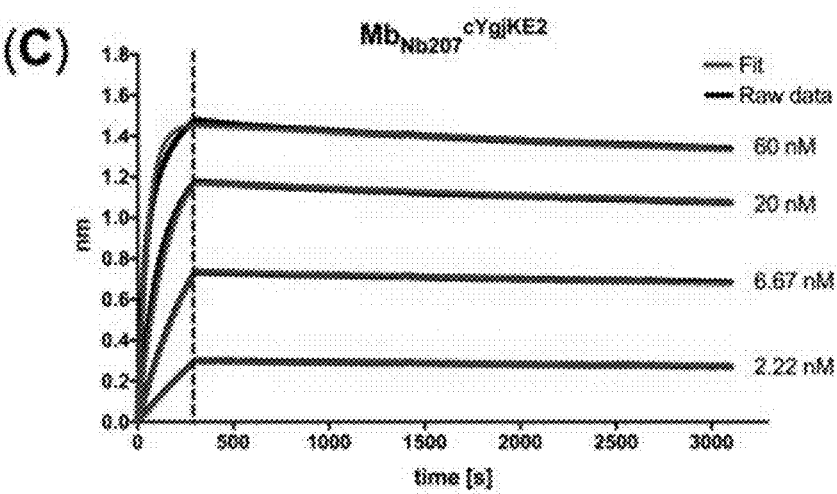
(D)
| | $K_D$ (pM) | $k_{on} \times 10^5 (M^{-1}s^{-1})$ | $k_{off} \times 10^5 (s^{-1})$ |
|---|---|---|---|
| Nb207 | 38.2 | 6.530±0.015 | 2.51±0.01 |
| $Mb_{Nb207}^{cHopQ}$ | 76.8 | 4.018±0.008 | 3.09±0.01 |
| $Mb_{Nb207}^{cYgjKE2}$ | 86.8 | 3.346±0.007 | 2.90±0.01 |

(B)

Figure 44
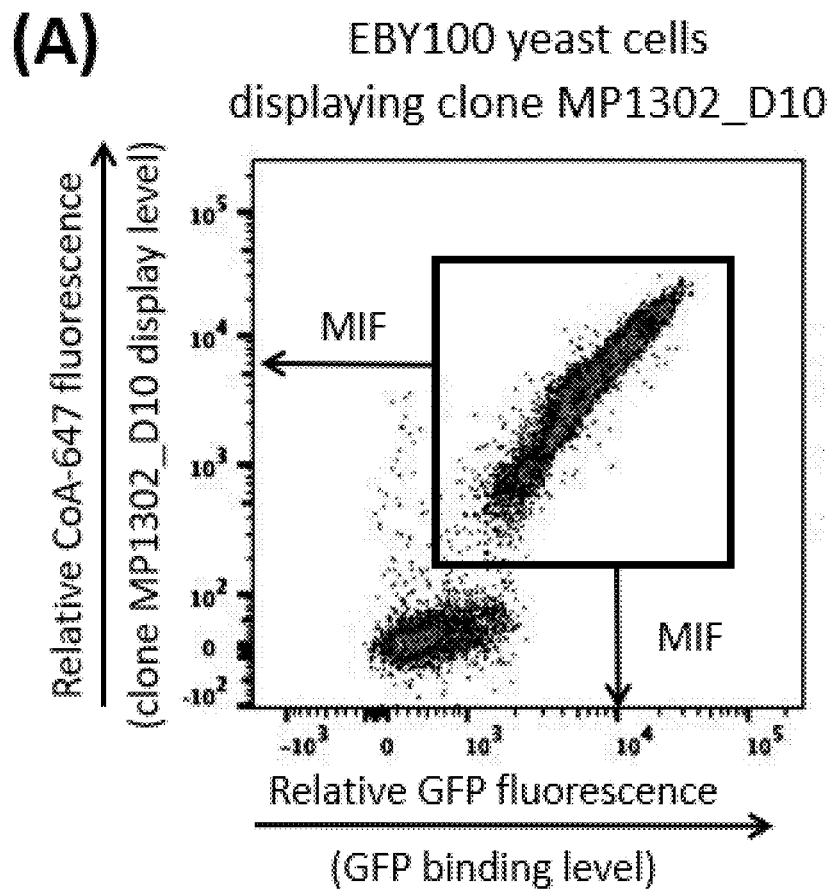
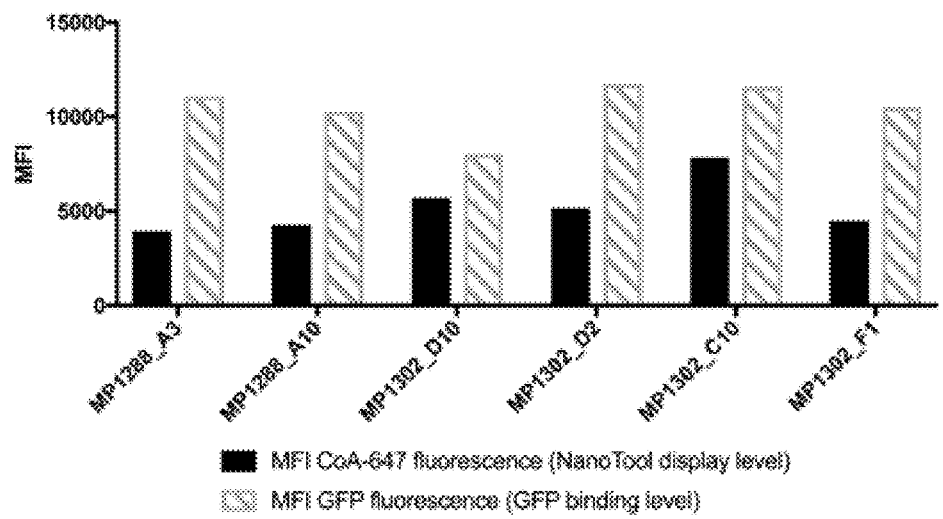

(B)

(A)

(B)

(D)

MQVQLVESGGGL(X)$_i$ TYRVIEIVGTSPDGVDAAIQGGLARAAQTMRALDWFEVQSI
RGHLVDGAVAHFQVTMKVGFR(X)$_i$ SLRLSCAASGRTFSTAAMGWFRQAPGKERDF
VAGIYWTVGSTYYADSAKGRFTISRDNAKNTVYLQMDSLKPEDTAVYYCAARRRG
FTLAPTRANEYDYWGQGTQVTVSShhhhhhepea (C) QVQLVESGGGLV(X)$_{1-2}$MQVQDLTGAALDYWVATAEGHEVPRADASGCTSIREPGGVPTPFAPSSSWADGGPIVERLPFAGFERDGGRGAWRAVLHRAVPAAGERCTFNQSGPTLLIAAMRTLVASTFGDD(X)$_{1-2}$GSLRLSCAASGRTFSTAAMGWFRQAPGKERDFVAGIYWTVGSTYYADSAKGRFTISRDNAKNTVYLQMDSLKPEDTAVYYCAARRRGFTLAPTRANEYDYWGQGTQVTVSShhhhhhepea

ANTIGEN-BINDING CHIMERIC PROTEINS AND METHODS AND USES THEREOF

FIELD OF THE INVENTION

The present invention relates to the field of structural biology. More specifically, the present invention relates to novel antigen-binding chimeric proteins, their uses and methods in three-dimensional structural analysis of macromolecules, such as X-ray crystallography and high-resolution Cryo-EM, and their use as a therapeutic, diagnostic, or imaging tool. Even more specifically, the invention relates to a fusion of a scaffold protein and an antigen-binding domain wherein the scaffold protein in said fusion interrupts the Immunoglobulin domain topology to form a rigid chimer, which retained its antigen-binding capacity.

BACKGROUND

Proteins and their complexes have critical roles in all aspects of life, but the 3D-structural analysis of many of these macromolecular components remains difficult. The preparation of diffraction quality crystals remains the major bottleneck in macromolecular X-ray crystallography. An approach that holds promise is the use of crystallization chaperones (Hunte & Michel, 2002). These crystallization chaperones come in the form of antibody fragments or other proteins that have been engineered to bind specifically to a given macromolecular target. The basis for the strategy is to increase the probability of obtaining well-ordered crystals by first, minimizing the conformational heterogeneity in the target by binding to a specific conformation and second, supplementing the amount of protein surface that can facilitate primary contacts between molecules in the crystal lattice. An additional attribute inherent in the crystallization chaperone approach is that the chaperone can provide initial model-based phasing information (Koide, 2009). Nanobodies® have been widely used as facilitators for structural analysis, especially for crystallography of their targets as they stabilize specific conformations (Pardon et al., 2014; Rostislavleva et al., 2015). One example is the use of the powerful Nanobody® technology in the context of GPCR crystallization which demonstrates how these tools are likely to propel structural studies (Manglick et al., 2017; Staus et al., 2016).

Still, X-ray crystallography intrinsically holds several disadvantages, such as the prerequisite for high quality purified protein, the relatively large amounts of protein that are required, and the difficulty to obtain diffracting quality crystals of many proteins. Single particle electron cryomicroscopy (cryo-EM) has recently developed into an alternative and versatile technique for structural analysis of macromolecular complexes at atomic resolution (Nogales, 2016). Although instrumentation and methods for data analysis improve steadily, we are missing tools to analyse small size, low symmetry, and highly flexible particles to high resolution. In addition to the prerequisite homogeneity of a given sample, the highest achievable resolution of the 3D reconstruction is greatly dependent on the ability to iteratively refine the orientation parameters of each individual particle to high accuracy. Preferred particle orientation due to surface properties of the macromolecules that cause specific regions to preferentially adhere to the air-water interface or substrate support represent a recurring issue in cryo-EM. Accordingly, large molecules are relatively easy to recognize in noisy low-dose images of frozen hydrated samples, and these particles have sufficient structural features to facilitate accurate determination of their orientation parameters (Henderson, 1995), but the process of collecting and processing images of small particles is much more difficult. One fundamental limitation is that images of small proteins or complexes embedded in vitreous ice do not contain adequate features for accurate image alignment, mostly because the signal-to-noise ratio in the images decreases with the size of the particles. Efforts have been done to overcome these limitations by creating fusion proteins or adding chemical linkers to these proteins. For instance, optimized junctions between a target protein and multimer-forming glutamine synthetase were used as homo-oligomers to achieve symmetry, thereby allowing nanometer resolution of these smaller target proteins in cryo-EM (Coscia et al., 2016). The problem with such fusions is that they are made by flexible linkers, resulting in a lack of rigidity and limited conformational homogeneity. A more rigid fusion of a humanized antibody with a cytokine to create a humanized agonist has been reported by Zhang et al. (2015). The rigid fusion was made by using a coiled-coil 'stalk' motif for correct folding, which was based on a bovine Fab structural motif. A cytokine, coupled to such stalk motif in a fusion with the complementarity-determining-region (CDR) of the antibody appears to retain folding and biological activity of the cytokine, but with loss of the antigen binding capacity of the antibody. Antibody fragments such as Fabs (-50 kDa) have been applied to elucidate the structure of small proteins via Cryo-EM (Wu et al., 2012; Lin et al., 2013). One disadvantage of using Fabs is that they also bind linear epitopes, which is known to result in lower rigidity, so requiring a proper selection of the Fab required to obtain rigid binding and structural facilitation. Moreover, Fabs have internal flexibility (between their variable and constant domains), and are still relatively small in size, and more difficult to produce as compared to a Nanobody. Although Nanobodies are excellent tools to reduce the conformational heterogeneity for structural analysis, Nbs (15 kDa) also are small proteins and do not supplement large amounts of protein surface to facilitate primary contacts between molecules in the crystal lattice. Because they are so small, they are also poorly suited to facilitate size-related requirements for high-resolution Cryo-EM of small proteins.

For accurate structural analysis by X-ray crystallography or cryo-EM, a generic prototype solution of a rigid chaperone is required. So, the design of novel chimera, fused in a rigid manner instead of via flexible linkers, could be an advantage to build large conformationally stable protein structures. Taken together, there is a clear need for next generation chaperones that allow structural analysis of smaller proteins or proteins complexes, or even protein-protein interactions, via crystallization or single particle analysis, in particular cryo-EM. It would be advantageous to design and create such chaperones via a generic method to result in a reduced conformational flexibility of the target. First, as an auxiliary tool to add mass and/or add defined features to the target to improve resolution in such a way to obtain high resolution structures. Accordingly, this would be of benefit for structure-based drug design and aide in discovery and development of novel compounds. Second, also to provide a novel type of agents for biophysical, medical, as well as crop protection applications, including diagnostic or therapeutic goods that would benefit from increased rigidity.

SUMMARY OF THE INVENTION

The present invention relates to the design and generation of novel functional antigen-binding chimeric proteins and uses thereof, such as their role as next generation chaperones in structural analysis, as well as their use as therapeutic and diagnostic molecules. In particular, the antigen-binding chimeric proteins comprising an immunoglobulin or immunoglobulin-like domain and a scaffold protein have been designed by combining the advantageous functional features of the immunoglobulin or immunoglobulin-like domain including antigen-binding properties and specific to binding conformational epitopes on a target, with the advantageous structural features of the immunoglobulin domain that allow a scaffold protein to be fused in a versatile manner to the immunoglobulin domain in such a way that it interrupts the topology of the immunoglobulin domain without interfering with its folding or functionality. The resulting antigen-binding chimeric protein is obtained via expression of a genetic fusion between said antigen-binding domain and the scaffold protein, designed so that the scaffold, or fragments thereof, inserts within the topology of the antigen-binding domain. It is surprisingly shown that the resulting novel antigen-binding chimeric proteins are characterized by a high rigidity at their fusion regions and surprisingly retain their typical fold and functionality, i.e. they retain a high affinity to bind to their antigen or target protein. In fact, the genetic fusions made between the antigen-binding domain and the scaffold protein do not disturb or alter the complementarity-determining region (CDR) structure for antigen binding. The present invention thus provides a novel and unique type of antigen-binding chimeric proteins by having immaculately selected sites in exposed region(s) within the antigen-binding domain, to allow rigid non-flexible fusions with a scaffold protein, which are not straightforward to design. The antigen-binding chimeric proteins thereby provide a novel tool to facilitate high-resolution cryo-EM and X-ray crystallography structural analysis of small proteins by adding mass and supplying structural features. Indeed, mainly large and medium-sized macromolecular assemblies of homogeneous samples are yet enabled for characterization at atomic level in cryo-EM. So the antigen-binding chimeric proteins of the invention will aid in increasing particle size, in dealing with preferred particle orientation (also depending on the scaffold), and allow better alignment of fragments to result in lowering of size limits and increased resolution. So the design and generation of these next-generation chaperones for the structural analysis of any possible antigen or target allows to apply the antigen-binding chimeric protein as an supporting tool to add mass and/or add defined features to the target of interest to improve resolution in such a way to obtain high resolution structures. In fact, the antigen-binding chimeric protein are therefore advantageous as a tool in structural analysis, but also in structure-based drug design and screening, and become an added value for discovery and development of novel biologicals and small molecule agents. Furthermore, when such rigid fusions are made, and depending on the type of scaffold, for example a scaffold that comprises an antigen-binding or Ig domain itself, novel applications to apply antigen-binding chimera as active ingredients in the medical field arise, for instance as a novel rigid fusion therapeutic molecule, or in the crop protection field, providing protection agents. When antigen-binding chimera are made with labelled scaffolds, or even labelled antigen-binding domains, a novel diagnostic tool to accelerate technological improvements in for instance in vivo-imaging via noncovalent probing of the targets is also included in the invention.

The first aspect of the invention relates to an antigen-binding chimeric or fusion protein comprising an antigen-binding domain, which is connected to a scaffold or fusion partnering protein, wherein said scaffold protein is coupled to said antigen-binding domain at one or more amino acid sites accessible or exposed at the surface of said domain, resulting in an interruption of the topology of said antigen-binding domain. Said antigen-binding chimeric protein is further characterized in that it retains its antigen-binding functionality as compared to the antigen-binding domain not fused to said scaffold protein. Another embodiment discloses the antigen-binding chimeric protein of the invention, wherein the fusion of scaffold protein and antigen-binding domain results in an interrupted primary topology of the antigen-binding domain, allowing to retain the folding of said antigen-binding domain, as compared to the folding of the antigen-binding protein that is not fused to another protein.

In a particular embodiment of the invention, the fusions can be direct fusions, or fusions made by a linker or linker peptide, said fusion sites being immaculately designed to result in a rigid, non-flexible fusion protein. Preferably, the linker comprises ten, nine, eight, seven, six, five, four, three, or more preferably two, and even more preferably one amino acid residue, or is a direct fusion (no linker). In another embodiment, said antigen-binding chimeric protein is fused at least one or more accessible sites present at an exposed region, which is preferably a beta turn (β-turn) or loop of the antigen-binding domain. Said antigen-binding chimeric protein with a scaffold protein coupled to the antigen-binding domain at one or more accessible or exposed sites at the surface of the antigen-binding domain is further characterized in that said accessible or exposed sites are different from the antigen-binding loops or CDR loops, as to retain its antigen binding functionality. In one embodiment, said antigen-binding chimeric protein comprises an antigen-binding domain with at least 7 anti-parallel β-strands and at least 3 β-turns, connecting said β-strands, as defined according to the IMGT® global reference nomenclature (Lefranc, 2014; FIG. 25). In a particular embodiment, said antigen-binding domain of said antigen-binding chimeric protein comprises an immunoglobulin (Ig) domain or Ig fold. In a specific embodiment, the Ig domain of the antigen-binding chimeric protein is derived from a VHH, or more preferably derived from an immunoglobulin single variable domain (ISVD) or from a Nanobody.

In a particular embodiment, the exposed region of said antigen-binding domain of the antigen-binding chimeric protein specifically concerns β-turn AB, CC', C"D, DE, or EF, according to the IMGT nomenclature (FIG. 25, adapted from Lefranc, 2014). So the scaffold protein is inserted within the antigen-binding domain as follows: in the first β-turn that connects β-strand A and β-strand B of said antigen-binding domain; or in the β-turn that connects β-strand C and β-strand C' of said antigen-binding domain; or in the β-turn that connects β-strand C" and β-strand D of said antigen-binding domain; or in the β-turn that connects β-strand D and β-strand E of said antigen-binding domain; or in the β-turn that connects β-strand E and β-strand F of said antigen-binding domain (wherein said β-turn is defined as by IMGT, LeFranc 2014). In a specific embodiment, the antigen-binding chimeric protein is generated via fusion of the scaffold protein to an accessible site in the exposed region of said domain involving the β-turn AB, which connects β-strand A and β-strand B of said antigen-binding domain.

In another embodiment of the invention, the scaffold protein used to generate the antigen-binding chimeric protein is a circularly permutated protein, more specifically, the circular permutation can be made between the N- and C-terminus of said scaffold protein. In certain embodiments, the circularly permutated scaffold protein is cleaved at another accessible site of said scaffold protein, to provide a site for fusion to the accessible site(s) of the Ig domain.

Another embodiment relates to an antigen-binding chimeric protein, wherein the scaffold protein is a monomeric protein. In an alternative embodiment, the scaffold protein has a symmetric structure, such as a multimer or oligomer-forming protein or a protein which is part of or forming an icosahedral structure, such as a virus-like particle (VLP). In a particular embodiment, said antigen-binding chimeric protein wherein the scaffold is a multimer is connected or fused with the Ig domain its accessible site(s) via each of the monomers of said multimeric scaffold. In another embodiment, the antigen-binding domain and the scaffold protein of the antigen-binding chimeric protein are additionally connected via a disulphide bond, covalently formed between two Cysteine residues present on either the antigen-binding domain and the scaffold protein. Another embodiment of the invention relates to antigen-binding chimeric proteins wherein the total molecular mass of the scaffold protein(s) is at least 30 kDa.

A particular embodiment of the invention relates to an antigen-binding chimeric protein, wherein the scaffold protein comprises an antigen-binding. In particular, said scaffold protein comprises an immunoglobulin domain, or more particular a VHH, an ISVD, or a Nanobody. Alternatively, said scaffold protein comprises an immunoglobulin-like domain, more specifically, a monobody. More specifically, an antigen-binding chimeric protein is provided wherein the antigen-binding domain as well as the antigen-binding domain-containing scaffold retain functionality in specifically binding their antigen targets. In a specific embodiment, said antigen-binding domain-containing scaffold binds a different target than the antigen-binding domain fused to the scaffold protein. In one alternative embodiment, the antigen target of the antigen-binding domain of the scaffold protein is identical to the antigen target of the antigen-binding protein domain fused with said scaffold protein. Even more specifically, the antigen target concerns the same protein for both antigen-binding domains of the antigen-binding chimeric protein, but their epitope on the antigen target is different.

In another embodiment, the scaffold protein of the antigen-binding chimeric protein is a labelled protein. In a specific embodiment, the label is a detectable label. In another embodiment, the antigen-binding domain of the antigen-binding chimeric protein is a labelled antigen-binding domain. More specifically, said label that is fused or connected and/or provided by the antigen-binding domain or by the scaffold protein, allows in vivo and/or non-covalent detection or labelling of the antigen target of the antigen-binding domain of the novel antigen-binding chimeric protein. In a particular embodiment, said labelled antigen-binding chimeric protein may comprise a toxic label, and is applicable for therapeutic use.

A further aspect of the invention relates to a nucleic acid molecule encoding any of the antigen-binding chimeric proteins as described above. Alternatively, in one embodiment, a chimeric gene is provided with at least a promoter, said nucleic acid molecule encoding the antigen-binding chimeric protein, and a 3' end region containing a transcription termination signal. Another embodiment relates to an expression cassette encoding said antigen-binding chimeric protein, or comprising the nucleic acid molecule or the chimeric gene encoding said antigen-binding chimeric protein. Further embodiments relate to vectors comprising said expression cassette or nucleic acid molecule encoding the antigen-binding chimeric protein of the invention. In particular embodiments, said vector is suited for expression in *E. coli*, or for yeast, phage, bacteria or viral (surface) display. In another embodiment, a host cell comprising the antigen-binding chimeric protein of the invention is disclosed. Alternatively, a host cell wherein said antigen-binding chimeric protein and its target antigen are co-expressed.

Another aspect of the invention relates to a complex comprising said antigen-binding chimeric protein, and its target protein, wherein said target protein is specifically bound to said antigen-binding chimeric protein. More particular, wherein said target protein is bound to the antigen-binding domain of said antigen-binding chimeric protein, even more particular, to the Ig domain, or even more specific to the CDRs of the Ig domain of said antigen-binding chimeric protein.

Another embodiment provides a composition comprising said antigen-binding chimeric protein, or more specifically a pharmaceutical composition of said antigen-binding chimeric protein.

Another embodiment of the invention relates to a composition which comprises a complex formed between a first and a second antigen-binding chimeric protein according to the invention, wherein the antigen-binding domain of said second antigen-binding chimeric protein specifically binds or recognized the scaffold protein of the first antigen-binding chimeric protein.

Another aspect relates to the use of the antigen-binding chimeric protein of the present invention or to the use of the nucleic acid molecule, the chimeric gene, the expression cassette, the vectors, the complex, or the compositions, for structural analysis of a target or antigen protein. In particular, the use of the antigen-binding chimeric protein wherein said target protein is a protein bound to said antigen-binding chimeric protein. Specifically, an embodiment relates to the use of the antigen-binding chimeric protein in structural analysis comprising single particle cryo-EM or comprising crystallography.

Another embodiment provides the use of said antigen-binding chimeric protein, wherein the scaffold protein, or even the antigen-binding domain is labelled, for a diagnostic tool, or more specifically for in-vivo imaging.

An alternative embodiment provides said antigen-binding chimeric proteins as described above, or the nucleic acid molecule, expression cassette, vector, complex, or compositions provided in the present invention, for use as a medicament.

A specific embodiment relates to a Virus-like particle (VLP) comprising an antigen-binding chimeric protein of the present invention.

A final aspect of the invention relates to a method of determining the 3-dimensional structure of a target or antigen protein or protein of interest, comprising the steps of:
(i) Providing an antigen-binding chimeric protein of the present invention, or composition comprising a complex of antigen-binding chimeric proteins of the invention, and the target protein to form a complex, wherein said target protein is specifically bound to the antigen-binding chimeric protein, or to the composition of antigen-binding chimeric proteins, or alternatively, providing the complex of the current invention;
(ii) and display said mix or complex in suitable conditions, for structural analysis, wherein the 3D structure of said antigen or target protein is determined at high-resolution.

DESCRIPTION OF THE FIGURES

The drawings described are only schematic and are non-limiting. In the drawings, the size of some of the elements may be exaggerated and not drawn on scale for illustrative purposes.

The patent of application file contains at least one drawing executed in color. Copies of this patent or patent application publication with color drawings will be provided by the office upon request and payment of the necessary fee.

FIG. 1. Flexible fusion proteins compared to rigid antigen-binding chimeric proteins (A) Flexible fusions or linkers at the N- or C-terminal end of an antigen-binding domain and a scaffold protein using only one direct fusion or linker. (B) Rigid fusions of an antigen-binding domain and a scaffold protein, wherein the antigen-binding domain is fused with the scaffold protein via at least two direct fusions or linkers that connect antigen-binding domain to scaffold.

Figure 25:
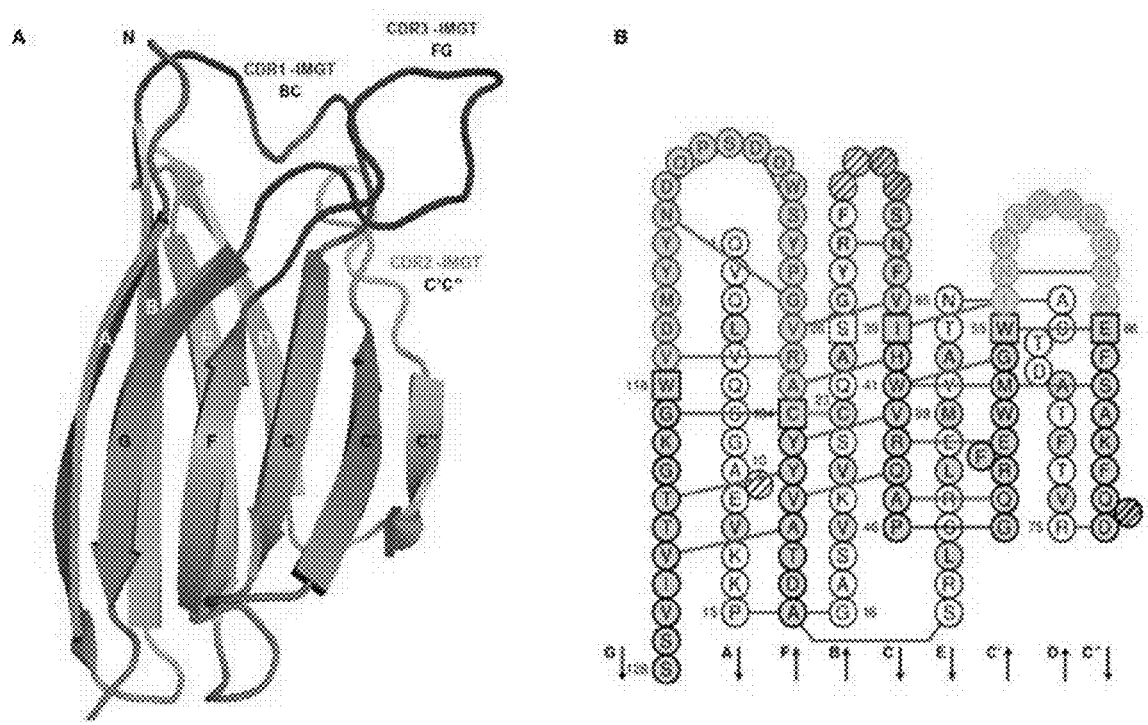
Figure 26:
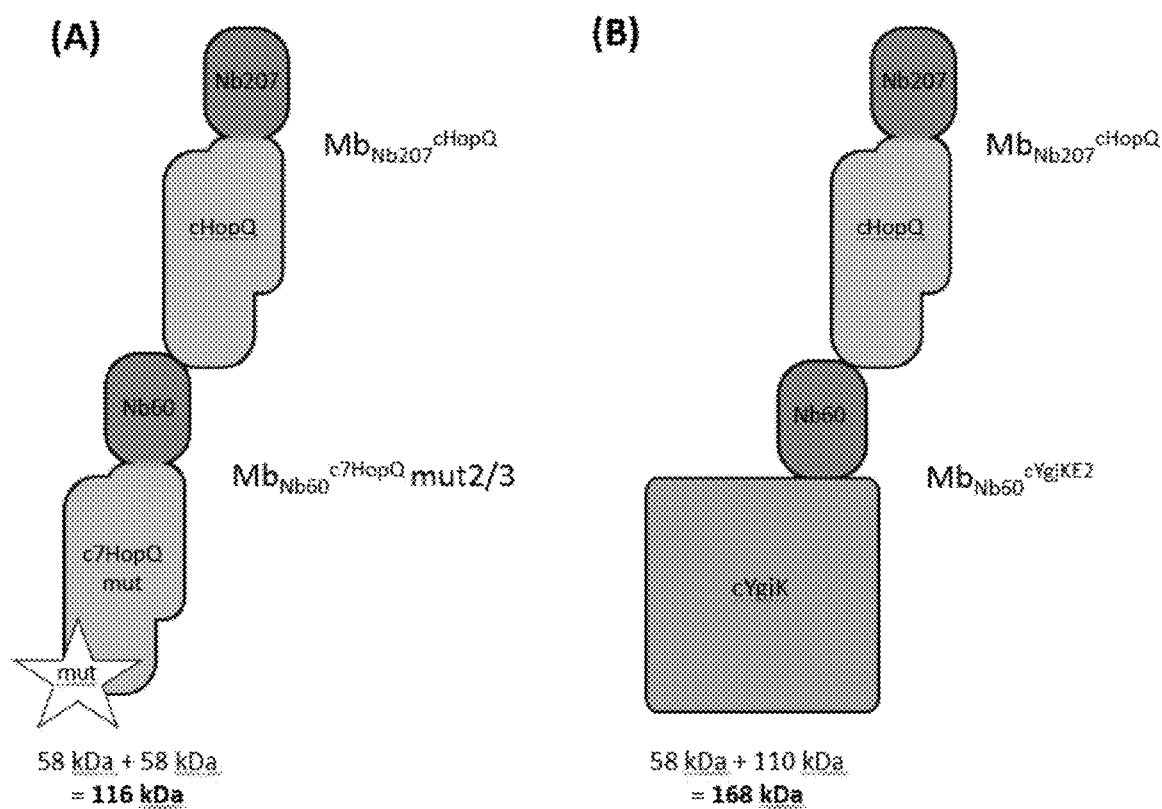
Figure 27:
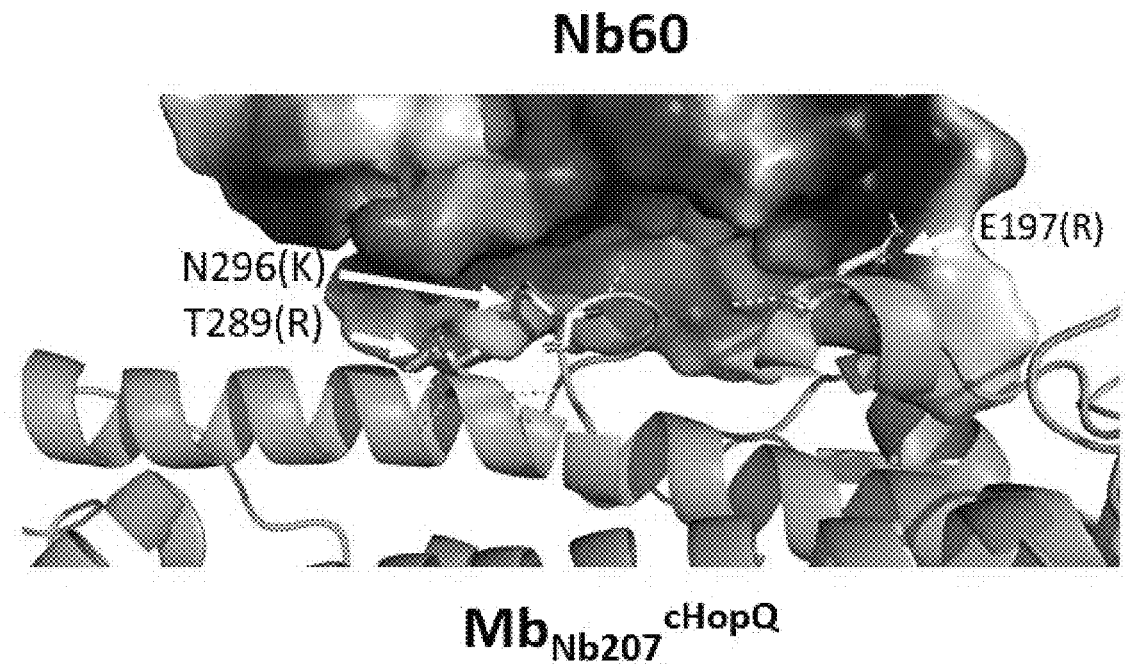

This scheme shows how a Nanobody (Nb) can be grafted onto a large scaffold protein via two peptide bonds or two short linkers that connect the antigen-binding domain to the scaffold. Scissors indicate which exposed turns have to be cut in the Nanobody and the scaffold. Dashed lines indicate how the remaining parts of the Nb and the scaffold have to be concatenated by use of peptide bonds or short peptide linkers to build the antigen-binding chimeric protein. CDRs, framework residues and β-turn regions of the Nb are defined according to IMGT (FIG. 25 adapted from Lefranc, 2014).

Figure 3:
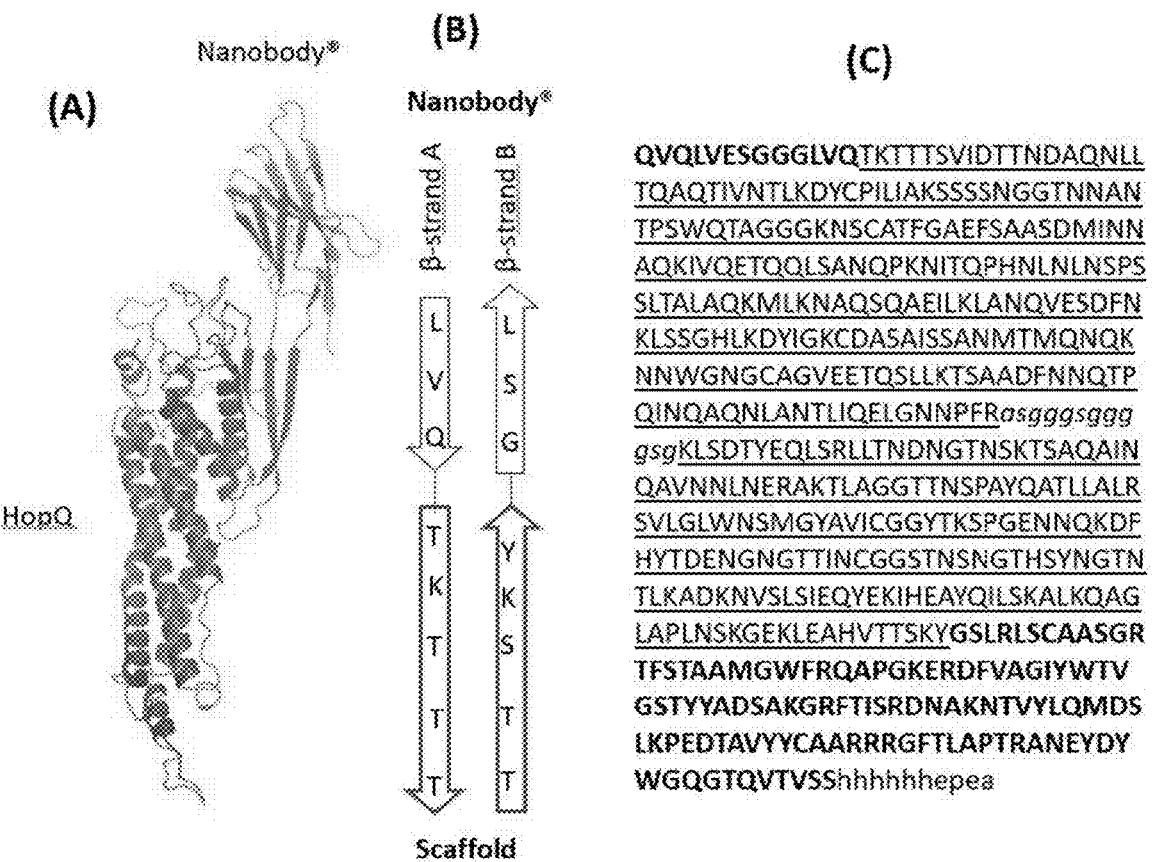

FIG. 3. Model of a 58 kD GFP-binding chimeric protein built from a circularly permutated variant of HopQ inserted into the first β-turn connecting β-strands A and B of a GFP-specific Nanobody.

(A) Model of an antigen-binding chimeric protein made by fusion of a GFP-specific Nanobody (top) and a circularly permutated variant of the Adhesin domain of HopQ of *H. pylori* (bottom) via two peptide bonds or linkers that connect Nanobody to scaffold. (B) A circularly permutated gene encoding the Adhesin domain of the type 1 HopQ of *Helicobacter pylori* strain G27 (bottom, PDB 5LP2, SEQ ID NO:19, cHopQ) was inserted in the first β-turn of a GFP-specific Nanobody (top, SEQ ID NO:1) connecting β-strand A to β-strand B (β-turn AB). (C) Amino acid sequence of the resulting antigen-binding chimeric protein ($Mb_{Nb207}^{cHopQ}$, SEQ ID NO:20). Sequences originating from the Nanobody are depicted in bold. Sequences originating from HopQ are underlined. The peptide linking the N-terminus and the C-terminus of the HopQ to make a circular permutant is depicted in italics. The C-terminal tag includes 6×His and EPEA.

Figure 4:
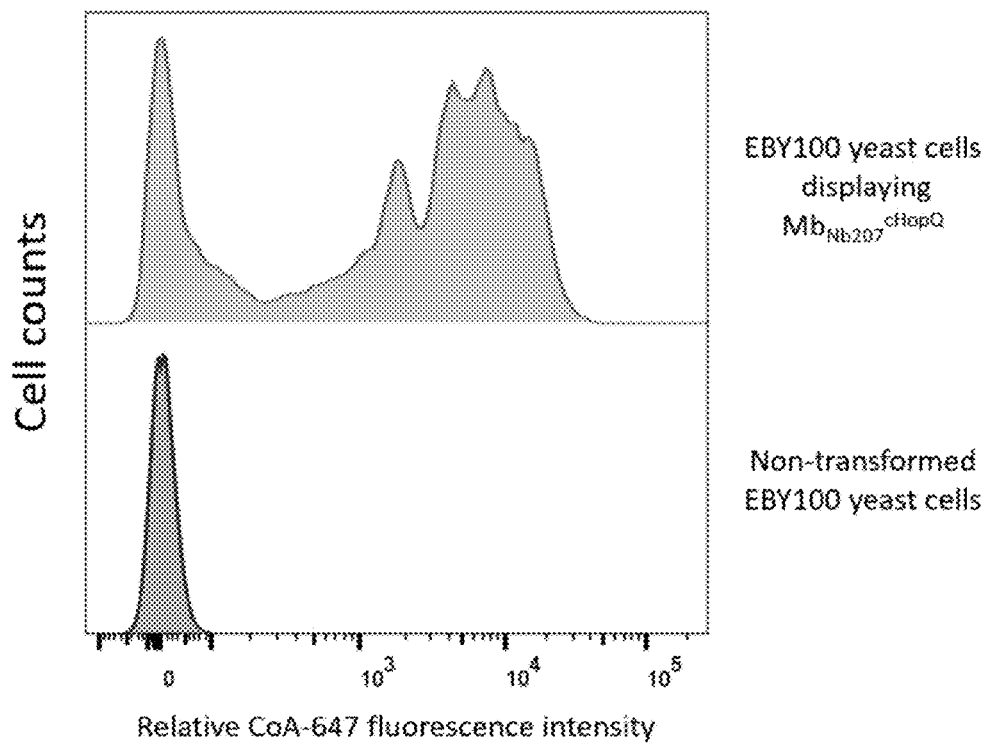

FIG. 4. Flow cytometric analysis of the display of the antigen-binding chimeric protein $Mb_{Nb207}^{cHopQ}$ on the surface of EBY100 yeast cells The single-parameter histograms show the relative fluorescence intensity of EBY100 yeast cells transformed with a pCTCON2 derivative encoding the antigen-binding chimeric protein $Mb_{Nb207}^{cHopQ}$ fused to Aga2p and ACP (SEQ ID NO:22) (top) compared to untransformed EBY100 yeast cells (bottom).

Transformed and untransformed yeast cells were orthogonally stained with CoA-647 (2 µM) using the SFP synthase (1 µM).

Figure 5:
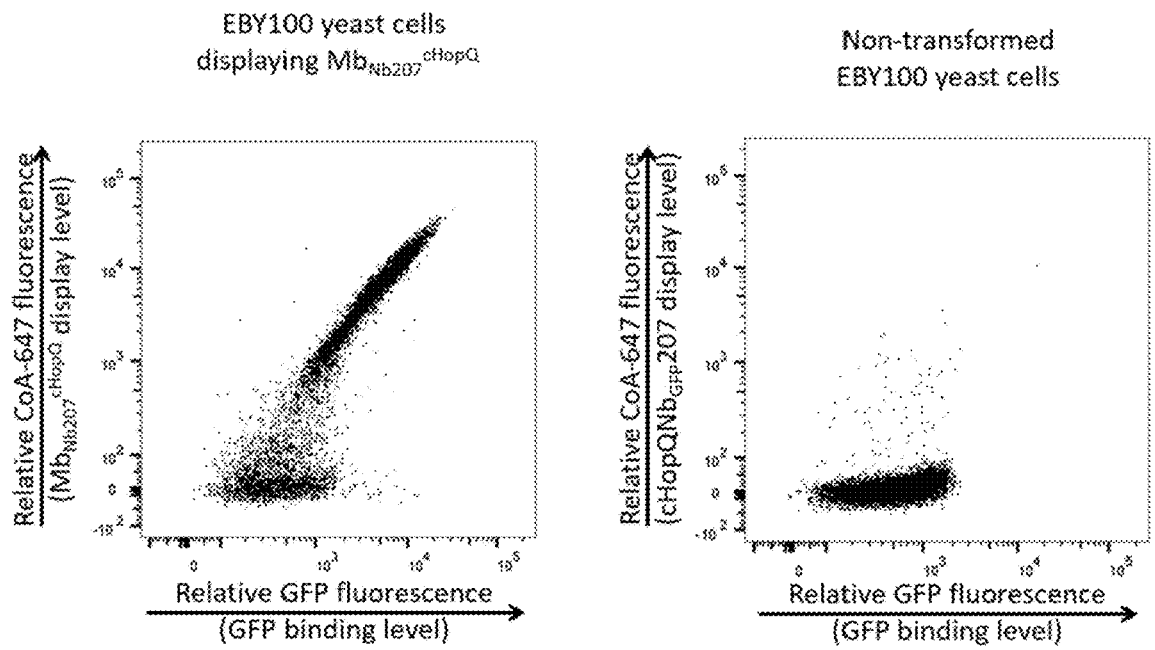

FIG. 5. Flow cytometric analysis of the functionality of antigen-binding chimeric protein $Mb_{Nb207}^{cHopQ}$ that is displayed on the surface of EBY100 yeast cells Dot plot representation of the relative fluorescence intensity of individual EBY100 yeast cells transformed with a pCTCON2 derivative encoding $Mb_{Nb207}^{cHopQ}$ fused to Aga2p and ACP (SEQ ID NO:22) (top) compared to untransformed EBY100 yeast cells (bottom). Transformed and untransformed yeast cells were orthogonally stained with CoA-647 (2 µM) using the SFP synthase (1 µM) and incubated with 100 nM GFP.

Figure 6:
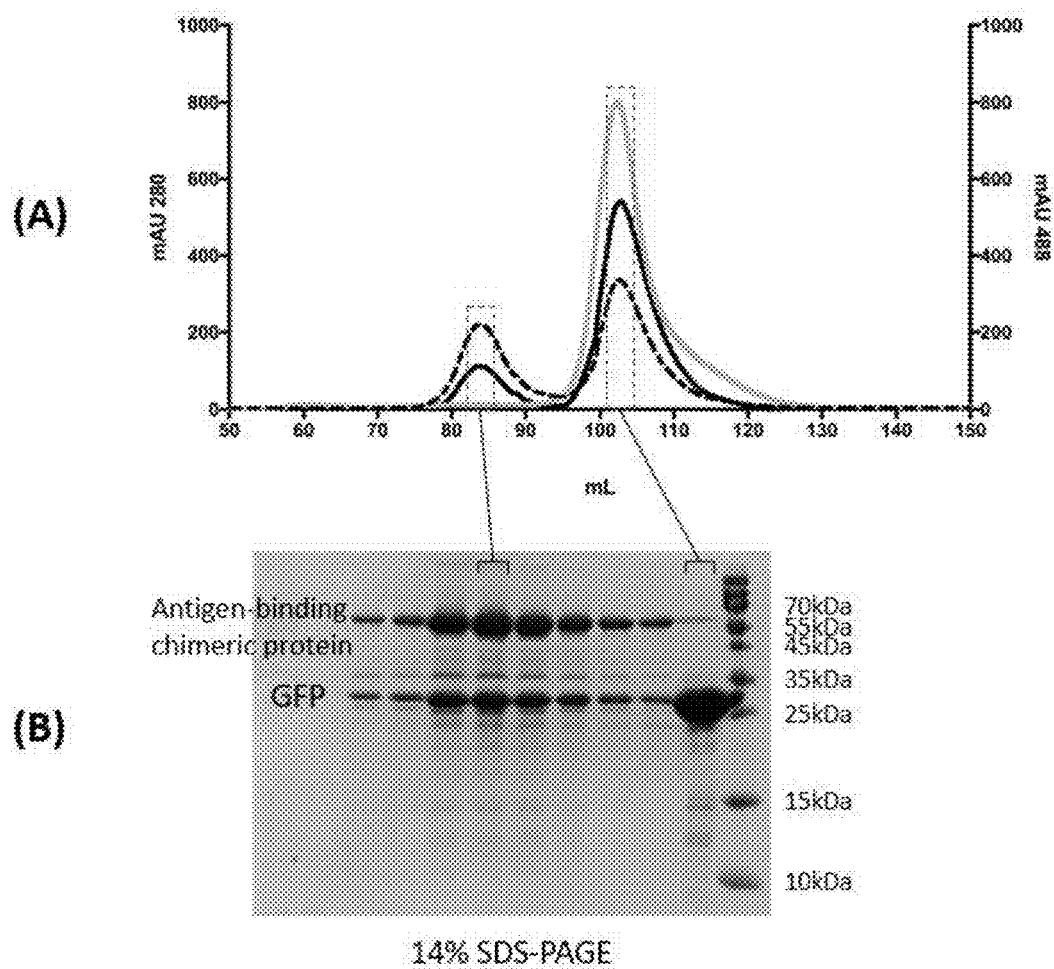

FIG. 6. Analysis of the formation of a complex between antigen-binding chimeric protein $Mb_{Nb207}^{cHopQ}$ and GFP by size exclusion chromatography and SDS-PAGE Analytical gel filtration experiments on a Superdex 75 PG column (16/90, GE Healthcare) to confirm the formation of a stable complex between $Mb_{Nb207}^{cHopQ}$ (SEQ ID NO:20) and green fluorescent protein (GFP) (Scholz et al., 2000). (A) Analysis of the formation of a complex by SEC. Grey line: gel filtration pattern of a sample containing GFP alone measured by UV 280 nm absorption. Black dashed line: gel filtration pattern of a sample containing $Mb_{Nb207}^{cHopQ}$ and GFP in α1:4 molar ratio measured by UV 280 nm absorption. Black line: gel filtration pattern of a sample containing $Mb_{Nb207}^{cHopQ}$ and GFP in α1:4 molar ratio measured by UV 488 nm absorption. (B) Confirmation of the formation of a stable complex between antigen-binding chimeric protein $Mb_{Nb207}^{cHopQ}$ and GFP by SDS page. A sample containing $Mb_{Nb207}^{cHopQ}$ and GFP in α1:4 molar ratio was applied to a Superdex 75 PG column and the relevant fractions were analysed by SDS-PAGE.

FIG. 7. X-ray crystal structure of a 58 kD GFP-binding chimeric protein built from a circularly permutated variant of HopQ inserted into the first β-turn connecting β-strands A and B of a GFP-specific Nanobody.

(A) Arrangement of 10 GFP-binding chimeric proteins (cartoon representation) in the asymmetric unit. The 58 kD antigen-binding chimeric protein $Mb_{Nb207}^{cHopQ}$ (SEQ ID NO:20) crystallized in spacegroup P1 with 10 molecules in the asymmetric unit. The Adhesin domain of HopQ (PDB 5LP2) used as scaffold is depicted in red, the GFP-specific Nb is depicted in green. (B) The peptides connecting Nanobody to scaffold (Molecule A) are clearly defined in the 2Fo-Fc electron density map contoured at 1.0σ. (C) Structural alignment of all the antigen-binding chimeric proteins $Mb_{Nb207}^{cHopQ}$ contained in the asymmetric unit. The RMSD's between the different molecules in the asymmetric unit range from 0.3 to 2.7 Å.

FIG. 8. Yeast display vector for the optimization of the composition and the length of the linker peptides connecting scaffold protein HopQ to a Nanobody (A) Schematic representation of the display vector. LS: the engineered secretion signal of yeast α-factor, appS4 (Rakestraw et al. 2009) that directs extracellular secretion in yeast. N: β-strand A of the anti-GFP-Nanobody (1-13 of SEQ ID NO:1), Nanobody: β-strands B to G of the anti-GFP-Nanobody (residues 16-126 of SEQ ID NO:1), Aga2: the Aga2p adhesion subunit of the yeast agglutinin protein Aga2p which attaches to the yeast cell wall through disulfide bonds to Aga1p protein (Chao et al., 2006), ACP: Acyl carrier protein for the orthogonal labelling of the displayed antigen-binding chimeric protein to monitor its expression level (Johnsson et al., 2005). (B) Sequence diversity of the displayed antigen-binding chimeric proteins (SEQ ID NO:34-37): AppS4 leader sequence in normal print, Megabody $cHopQNb_{GFP}207$ with random linkers depicted in bold, $(X)_{1-2}$ is a short peptide linker of variable length (1 or 2 amino acids) and mixed composition, flexible (GGGS)$_n$ polypeptide linker in italics, Aqa2p protein sequence underlined, ACPsequencedoubleunderlined, cMyc Tag. (C) By using equimolar mixtures of 2 forward (SEQ ID NO:126, SEQ ID NO:127) and 2 reverse PCR primers (SEQ ID NO:128, SEQ ID NO:129) to introduce the short peptide linkers of variable length (1 or 2 amino acids) and mixed composition, 4 pools of antigen-binding chimeric protein sequences were generated (each representing 25% of the library), encoding a total of 184.000 AA-sequence variants.

FIG. 9. Model of α100 kDa antigen-binding chimeric protein built from a circularly permutated variant of YgiK inserted into the first exposed β-turn (connecting β-strands A and B) of a GFP-specific Nanobody by in vitro selection.

(A) Model of an antigen-binding chimeric protein made by a fusion of a GFP-specific Nanobody (top) and *Escherichia coli* K12 YgjK (bottom). (B) A circularly permutated gene encoding the *Escherichia coli* K12 YgjK (PDB 3W7S, SEQ ID NO:38) was fused so that the YgjK protein was inserted in the first β-turn (β-turn AB) of the GFP-specific Nanobody (top, SEQ ID NO:1) connecting β-strand A to β-strand B using short peptide linkers of variable length (1 or 2 amino acids) and mixed composition. (C) Amino acid sequences of the 100 kDa antigen-binding chimeric proteins (SEQ ID NO:39-42). Nb$_{GFP}$207 sequences in bold, circular permutation linker in italics, Ygjk sequences underlined, (X)$_{1-2}$ is a short peptide linker of variable length (1 or 2 amino acids) and mixed composition. The C-terminal tag includes 6×his and EPEA.

FIG. 10. The 58 kD antigen-binding chimeric proteins built from a circularly permutated variant of HopQ inserted into the first β-turn connecting β-strands A and B of a GFP-specific Nanobody further rigidified by an engineered disulphide bond that connects Nanobody to scaffold.

To further increase the rigidity of the antigen-binding chimeric protein build from the adhesin domain of the type 1 HopQ of *Helicobacter pylori* strain G27 (bottom, PDB 5LP2, SEQ ID NO:19) that is inserted in the first β-turn (AB β-turn) of the GFP-specific Nanobody (SEQ ID NO:1) connecting β-strand A to β-strand B, we used site-directed mutagenesis to engineer an extra disulphide bond that connects Nanobody to scaffold. (A) Model of a mutant of the antigen-binding chimeric protein Mb$_{Nb207}$$^{cHopQ}$ containing an engineered disulphide bridge between C$_{357}$ and C$_{425}$ (SEQ ID NO:48). (B) Model of a mutant of Mb$_{Nb207}$$^{cHopQ}$ containing an engineered disulphide bridge between C$_{358}$ and C$_{488}$ (SEQ ID NO:49). (C) Model of a mutant of Mb$_{Nb207}$$^{cHopQ}$ containing an engineered disulphide bridge between C$_{359}$ and C$_{490}$ (SEQ ID NO:50). (D) Model of a mutant of Mb$_{Nb207}$$^{cHopQ}$ containing an engineered disulphide bridge between C$_{15}$ and C$_{534}$ (SEQ ID NO:51).

Figure 11:
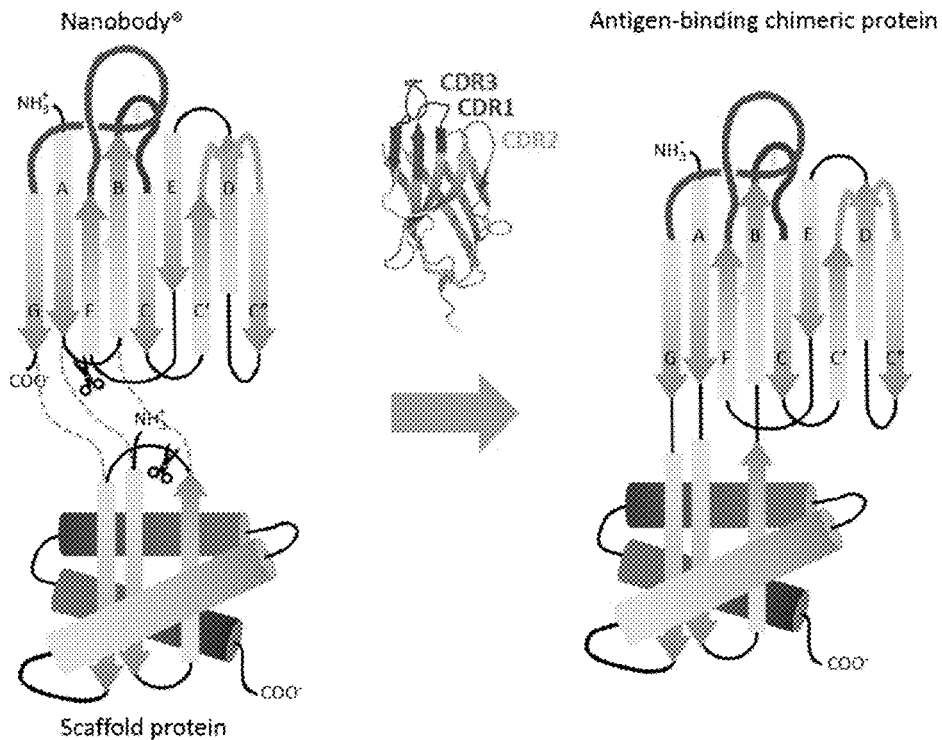

FIG. 11. Engineering principles of an antigen-binding chimeric protein built from a scaffold protein inserted into the first exposed β-turn (connecting β-strands A and B) of a Nanobody via three peptide bonds or short linkers connecting the immunoglobulin to the scaffold.

Antigen-binding domains can be fused to a scaffold protein at one or more accessible sites within an exposed region or β-turn, and/or at the accessible site at the end of the protein, via three direct fusions or 3 fusions made by a linker. In this scheme, we used β-turn AB and the C-terminal end of the Nanobody to connect the Ig domain to the scaffold via three peptide bonds or short linkers. Scissors indicate which exposed turns have to be cut in the Nanobody and the scaffold. Dashed lines indicate how the remaining parts of the Nb and the scaffold have to be concatenated by use of peptide bonds or short peptide linkers to build such antigen-binding chimeric protein. CDRs, framework residues and β-turn regions of the Nb are defined according to IMGT (FIG. 25 adapted from Lefranc, 2014).

Figure 12:
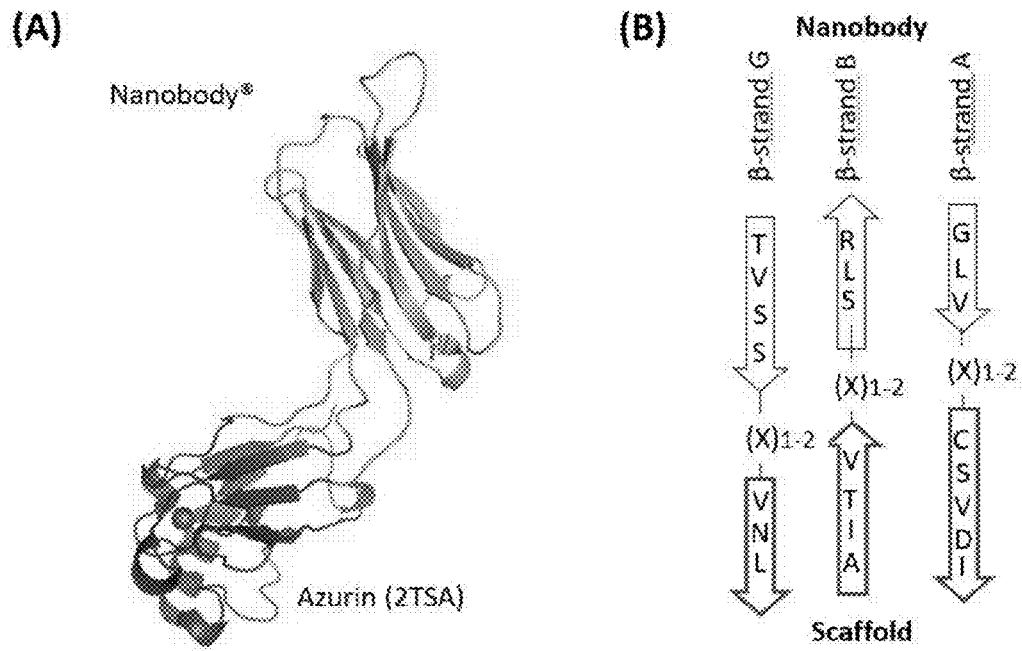

FIG. 12. Model of an antigen-binding chimeric protein built from a Cu++-binding protein Azurin inserted into the first β-turn connecting β-strands A and B of a GFP-specific Nanobody via three peptide bonds or short linkers connecting the immunoglobulin to the scaffold.

(A) Model of an antigen-binding chimeric protein made by a fusion of a GFP-specific Nanobody (top, SEQ ID NO:1) connected to Azurin of *Pseudomonas aeruginosa* (bottom, PDB 2TSA, SEQ ID NO:52) via three peptide linkers. The copper ion is depicted in blue. (B) The first β-strand of a Nanobody (β-strand A) is followed by the N-terminal part of the scaffold protein (Azurin), followed by the C-terminal part of the immunoglobulin, followed by the C-terminal part of the scaffold (Azurin). (C) Amino acid sequences of the resulting antigen-binding chimeric proteins (SEQ ID NO:53-60): Nb$_{GFP}$207 sequences in bold, Azurin sequences underlined, (X)$_{1-2}$ is a short peptide linker of variable length (1 or 2 amino acids) and mixed composition. The C-terminal tag includes 6×His and EPEA.

Figure 13:
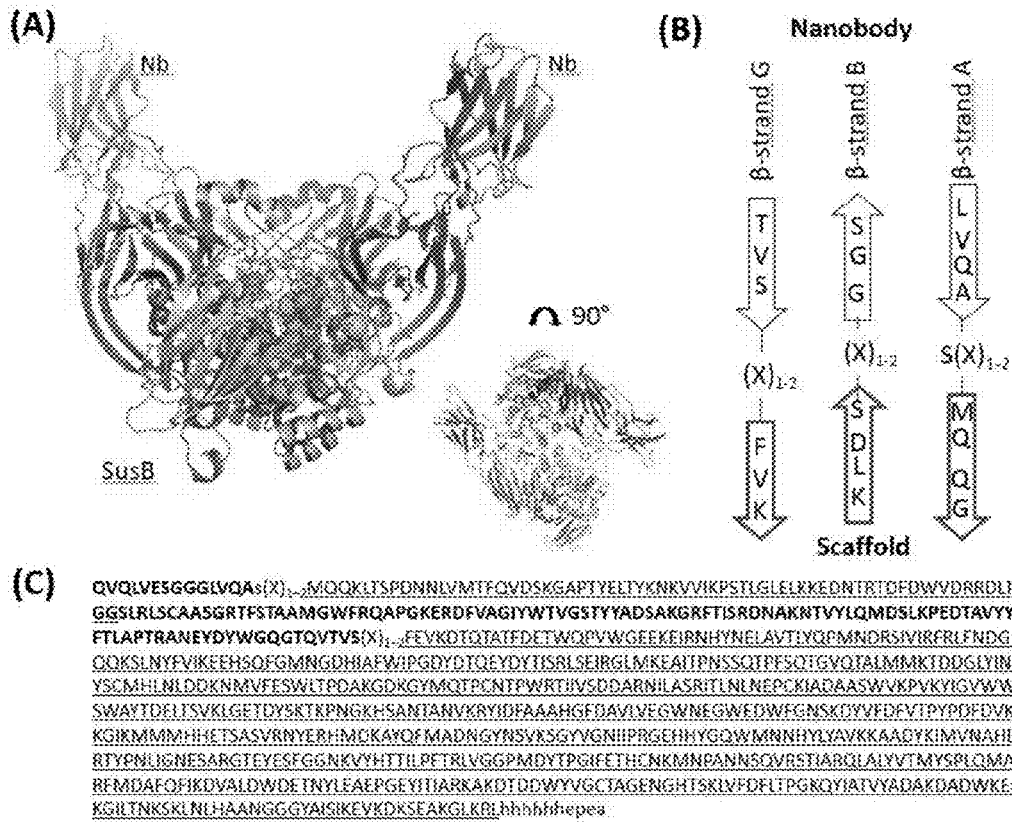

FIG. 13. Model of a dimeric antigen-binding chimeric protein with twofold symmetry built from invertinq glycoside hydrolase scaffold protein SusB inserted into the first exposed β-turn (connecting β-strands A and B) of a GFP-specific Nanobody via three peptide bonds or linkers connecting the immunoglobulin to the scaffold.

(A) Model of an antigen-binding chimeric protein made by a fusion of a GFP-specific Nanobody (top left and right, SEQ ID NO:1) connected to inverting glycoside hydrolase of *Bacteroides thetaiotaomicron* SusB (bottom, PDB 3WFA, SEQ ID NO:69) via three peptide linkers. SusB is an obligate dimer with twofold symmetry. (B) The first β-strand of a Nanobody (β-strand A) is followed by the N-terminal part of the scaffold protein (SusB), then followed by the C-terminal part of the immunoglobulin, then followed by the C-terminal part of the scaffold. (C) Amino acid sequences of the resulting antigen-binding chimeric proteins. Nb$_{GFP}$207 sequences in bold, (X)$_{1-2}$ is a short peptide linker of variable length (1 or 2 amino acids) and mixed composition, susB sequences underlined. The C-terminal tag includes 6×his and EPEA.

Figure 14:
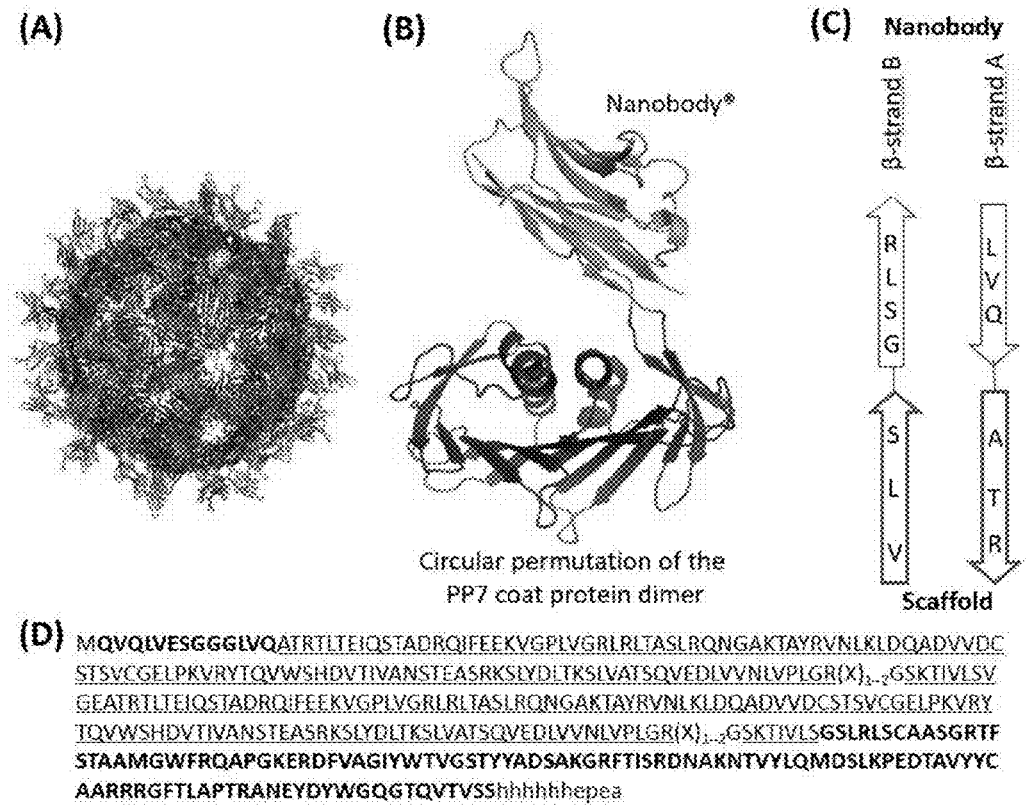

FIG. 14. Riqid display of a Nanobody on Icosahedral VLPs derived from bacteriophage PP7.

(A) Schematic representation of an icosahedral VLP (inner molecules), rigidly displaying 90 copies of a Nanobody (outer molecules) in a regular and rigid array. The wild type icosahedral PP7 virus has a T=3 shell composed of 180 identical copies of the PP7 coat protein, but two coat proteins can be fused N to C to generate VLPs that are composed of 90 covalent coat protein dimers (O'Rourke et al., 2015). (B) Model of an antigen-binding chimeric protein comprising a GFP-specific Nanobody (top, SEQ ID NO:1) connected to a circularly permutated variant of the covalent coat protein dimer of bacteriophage PP7 of *Pseudomonas Aeruginosa* (bottom, PDB 1 DWN). (C) Linking scheme of Nanobody to the permutated coat protein dimer of PP7. A circularly permutated gene encoding this covalent coat protein dimer of PP7 was inserted in the first β-turn of Nanobody that connects β-strand A to β-strand B (SEQ ID NO:3-6). (D) Amino acid sequences of the antigen-binding chimeric coat protein. Residues originating from the Nanobody are depicted in bold. (X)$_{1-2}$ is a short peptide linker of variable length (1 or 2 amino acids) and mixed composition. Sequences corresponding to the PP7 coat protein are underlined. The C-terminal tag includes 6×His and EPEA.

FIG. 15. Rigid display of a Nanobody on Icosahedral VLPs derived from bacteriophage MS2.

(A) Schematic representation of an icosahedral VLP (inner molecules), rigidly displaying 90 copies of a Nanobody (outer molecules) in a regular and rigid array. The wild type MS2 virus forms an icosahedral shell composed of 180 identical copies of the MS2 coat protein, but two coat proteins can be fused N to C to generate VLPs that are composed of 90 covalent coat protein dimers (O'Rourke et al., 2015). (B) Model of an antigen-binding chimeric protein comprising a lysozyme-specific Nanobody (top, SEQ ID NO:7) connected to a circularly permutated variant of the covalent coat protein dimer of bacteriophage MS2 of *Escherichia coli* (bottom, PDB 2MS2). (C) Linking scheme of Nanobody to the permutated coat protein dimer of MS2. A circularly permutated gene encoding this covalent coat protein dimer of MS2 was inserted in the first β-turn of Nanobody that connects β-strand A to β-strand B (SEQ ID NO:9). (D) Amino acid sequences of the antigen-binding chimeric coat protein. Residues originating from the Nanobody are depicted in bold. $(X)_{1-2}$ is a short peptide linker of variable length (1 or 2 amino acids) and mixed composition. Sequences corresponding to the MS2 coat protein are underlined. The C-terminal tag includes 6×His and EPEA.

FIG. 16. Model of an antigen-binding chimeric protein built from Acyl carrier protein inserted into the first β-turn connecting β-strands A and B of a GFP-specific Nanobody via two peptide bonds or short linkers connecting the antigen-binding domain to ACP (A) 3D Model of an antigen-binding chimeric protein made by a fusion of a GFP-specific Nanobody (top, SEQ ID NO:1) connected to Acyl carrier protein from *E. coli* (bottom, PDB 1T8K, SEQ ID NO:86) via two peptide linkers. In this particular antigen-binding chimeric protein, no circular permutation of the scaffold protein was required because the N-terminus and the C-terminus of wild type ACP are close to each other and well positioned for engineering two short polypeptide linkages that connect Nanobody to ACP. The reactive serine is in the bottom on the left side indicated. (B) The first β-strand of a Nanobody (β-strand A) is followed by ACP, then followed by the C-terminal part of the Nanobody. (C) Amino acid sequences of the resulting antigen-binding chimeric proteins. $Nb_{GFP}207$ sequences in bold, $(X)_{1-2}$ is a short peptide linker of variable length (1 or 2 amino acids) and mixed composition, ACP sequences are underlined. The C-terminal tag includes 6×His and EPEA.

Figure 17:
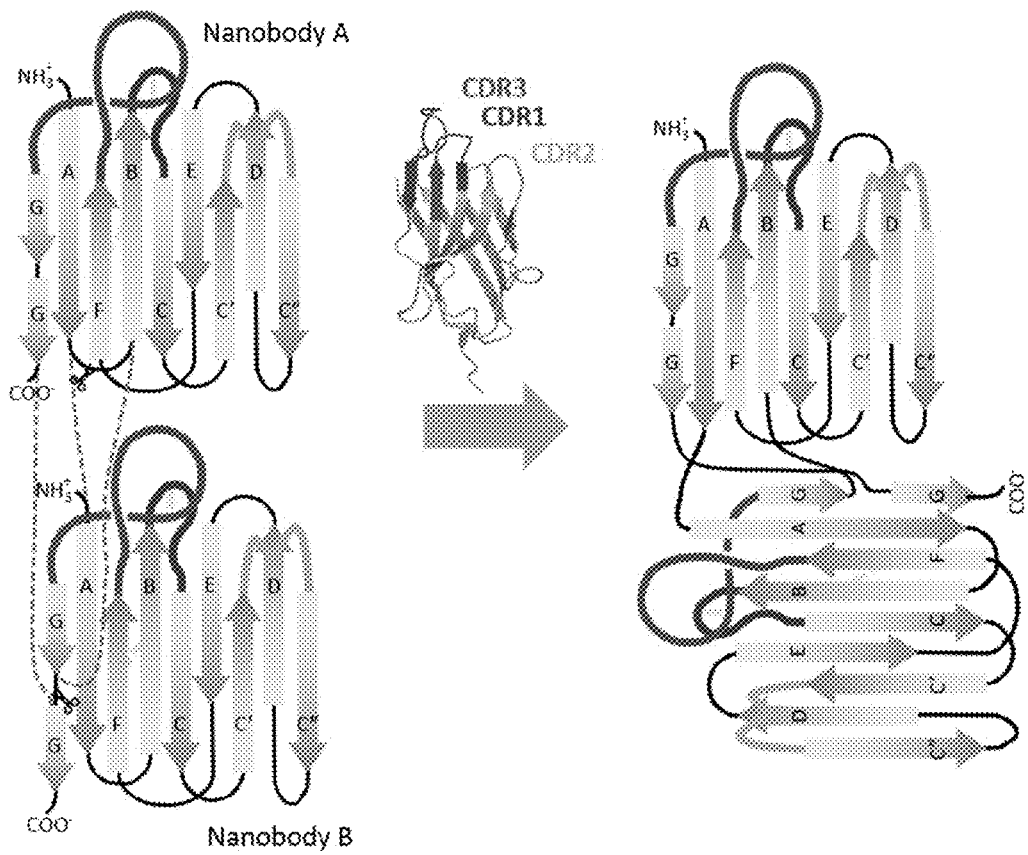

FIG. 17. Engineering principles of an antigen-binding chimeric protein built from a Nanobody inserted into another Nanobody via three peptide bonds or short linkers connecting both immunoglobulin domains.

This scheme shows how a Nanobody (Nb) can be fused with another Nanobody via three peptide bonds or three short linkers that connect one antigen-binding domain to another. Scissors indicate which exposed turns have to be cut in the Nanobodies to be linked. Dashed lines indicate how the remaining parts of both Nanobodies have to be concatenated by use of peptide bonds or short peptide linkers to build these antigen-binding chimeric proteins. CDRs, framework residues and β-turn regions of the Nb are defined according to IMGT (FIG. 25, adapted from Lefranc, 2014).

Figure 18:
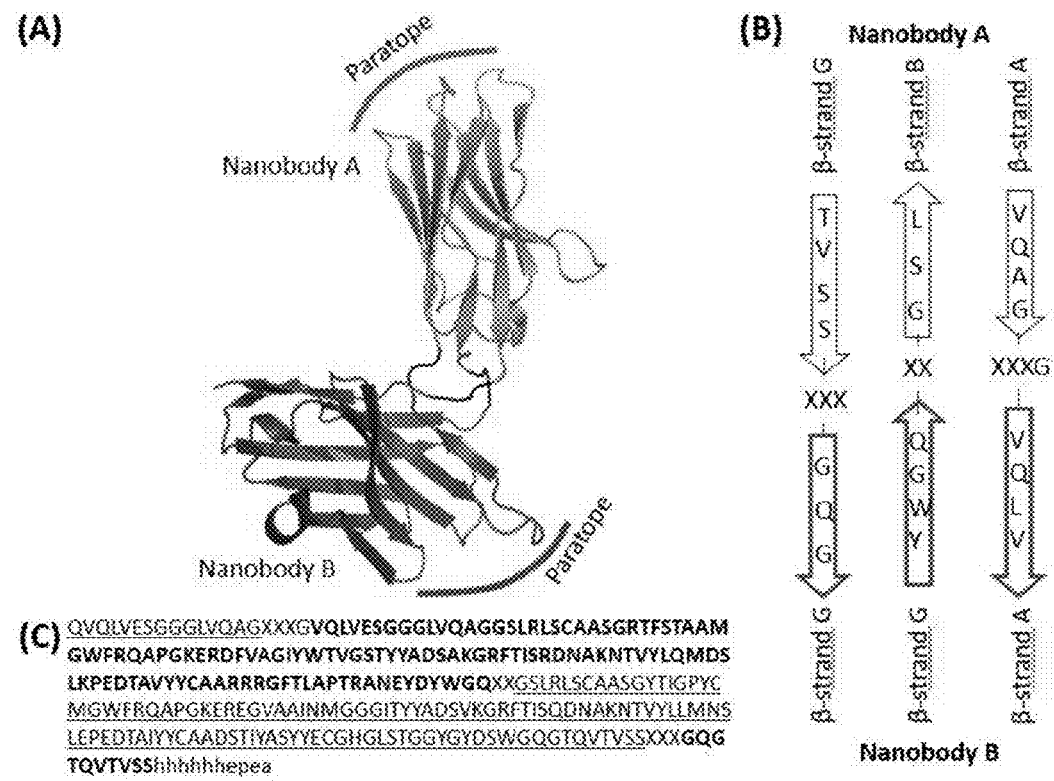

FIG. 18: Model of Nano2bodies Antigen-Binding Chimeric Protein (A) 3D Model of an antigen-binding chimeric protein made by a fusion of a GFP-specific Nanobody (Nanobody B, SEQ ID NO:1) connected to a lysozyme-binding Nanobody (Nanobody A, SEQ ID NO:7), via three peptide linkers according to FIG. 17. (B) Linking scheme of Nanobody A to Nanobody B. (C) Amino acid sequence (SEQ ID NO:14) of the resulting antigen-binding chimeric protein. β-strand A of the GFP-binding Nanobody double underlined. $Nb_{GFP}207$ sequences in bold, lysozyme-binding Nanobody sequences underlined. The C-terminal tag includes 6×His and EPEA.

Figure 19:
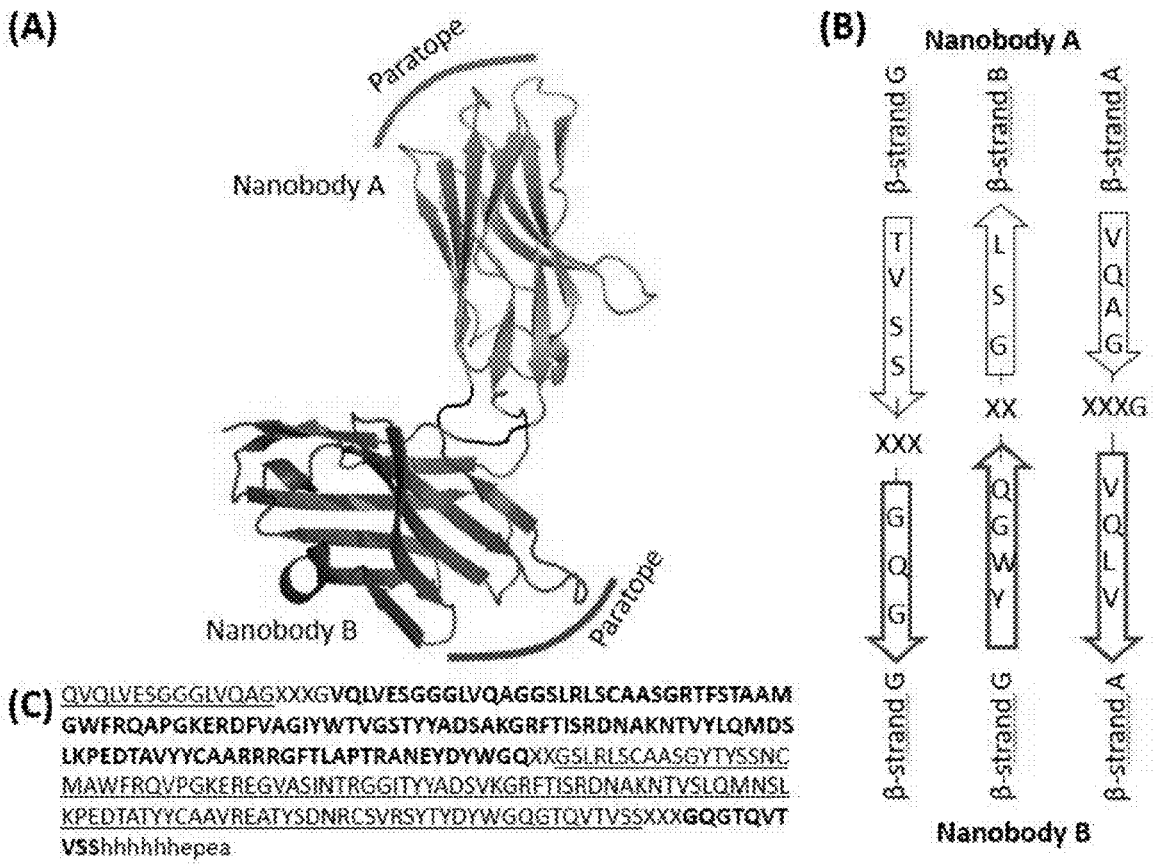

FIG. 19: Model of Nano2bodies Antigen-Binding Chimeric Protein (A) 3D Model of an antigen-binding chimeric protein made by a fusion of a GFP-specific Nanobody (Nanobody B, SEQ ID NO:1) connected to a FedF-binding Nanobody (Nanobody A, SEQ ID NO:17), via three peptide linkers according to FIG. 17. (B) Linking scheme of Nanobody A to Nanobody B. (C) Amino acid sequence (SEQ ID NO:18) of the resulting antigen-binding chimeric protein. β-strand A of the GFP-binding Nanobody double underlined. $Nb_{GFP}207$ sequences in bold, FedF-binding Nanobody sequences underlined. The C-terminal tag includes 6×His and EPEA.

Figure 20:
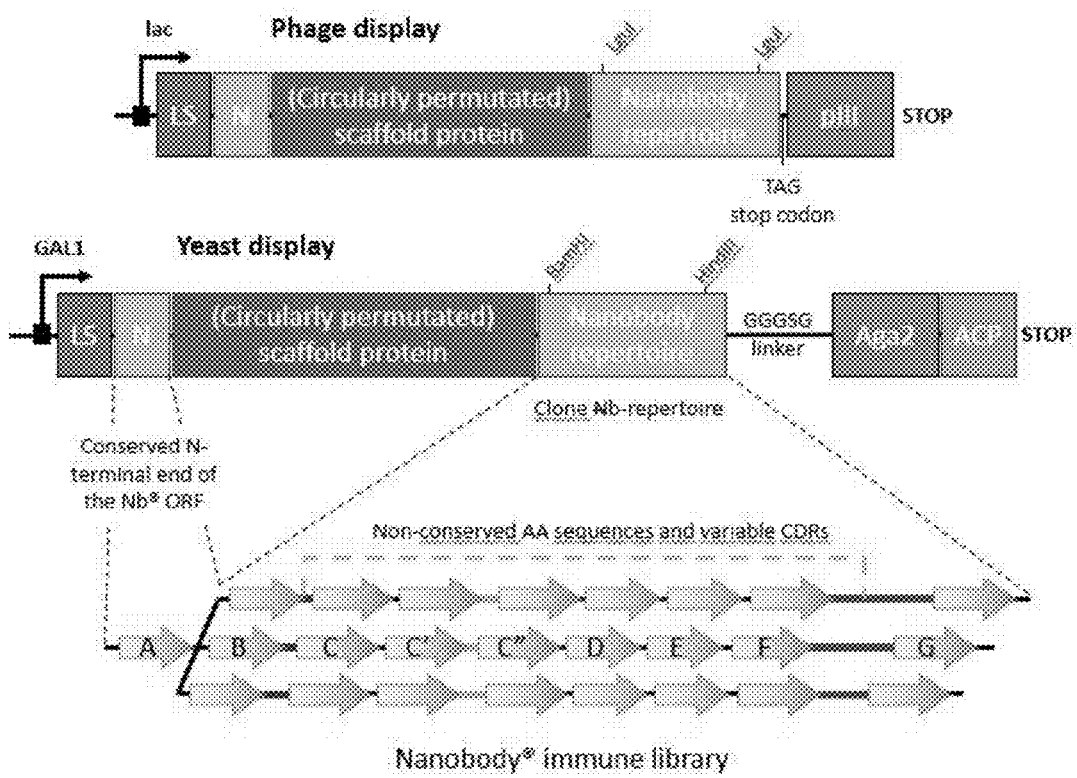

FIG. 20. Representative vectors for the generation and selection of antigen-binding chimeric proteins derived from Nanobody immune libraries by phage display or yeast display.

The vectors shown here encode antigen-binding chimeric proteins in which a Nanobody is fused with a large (optionally, circularly permutated) scaffold protein via two peptide bonds or via two short linkers that connect the antigen-binding domain to the scaffold. LS: leader sequence. pIII: Attachment protein of filamentous phage M13. Aga2: Aga2p mating protein that is projected away from the yeast cell surface. ACP: Acyl carrier protein for the orthogonal labeling of the displayed antigen-binding chimeric protein to monitor its expression level. Large antigen-binding chimeric protein display libraries can be constructed by cloning the C-terminal parts (including β-strands B to G) from collections of antigen-binding domain-encoding genes that can be cloned from immunized Llama's for instance in the case of Nanobodies or collected from synthetic libraries.

Figure 21:
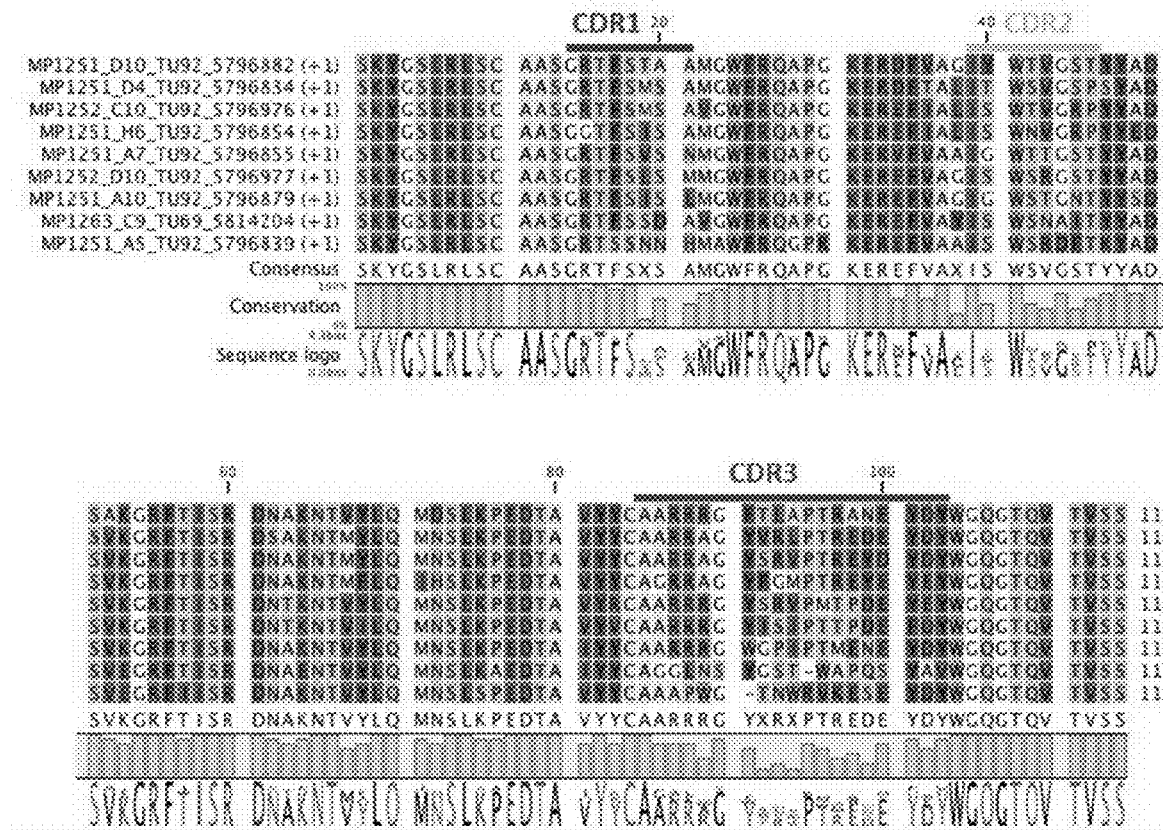

FIG. 21. Sequence Analysis of GFP-Specific Antigen-Binding Chimeric Proteins Derived from Nanobody Immune Libraries and Selected by Yeast Display Followed by FACS Multiple amino acid sequence alignment of nine GFP-specific antigen-binding chimeric proteins (SEQ ID NO:95-103) that have been selected by yeast display followed by FACS from antigen-binding chimeric protein libraries that have been constructed starting from Nanobodies that have been cloned from a blood sample of a Llama that was immunized with GFP and next fused to HopQ. Only the C-terminal parts of the Nanobodies including β-strand B to β-strand G are shown.

Figure 22:
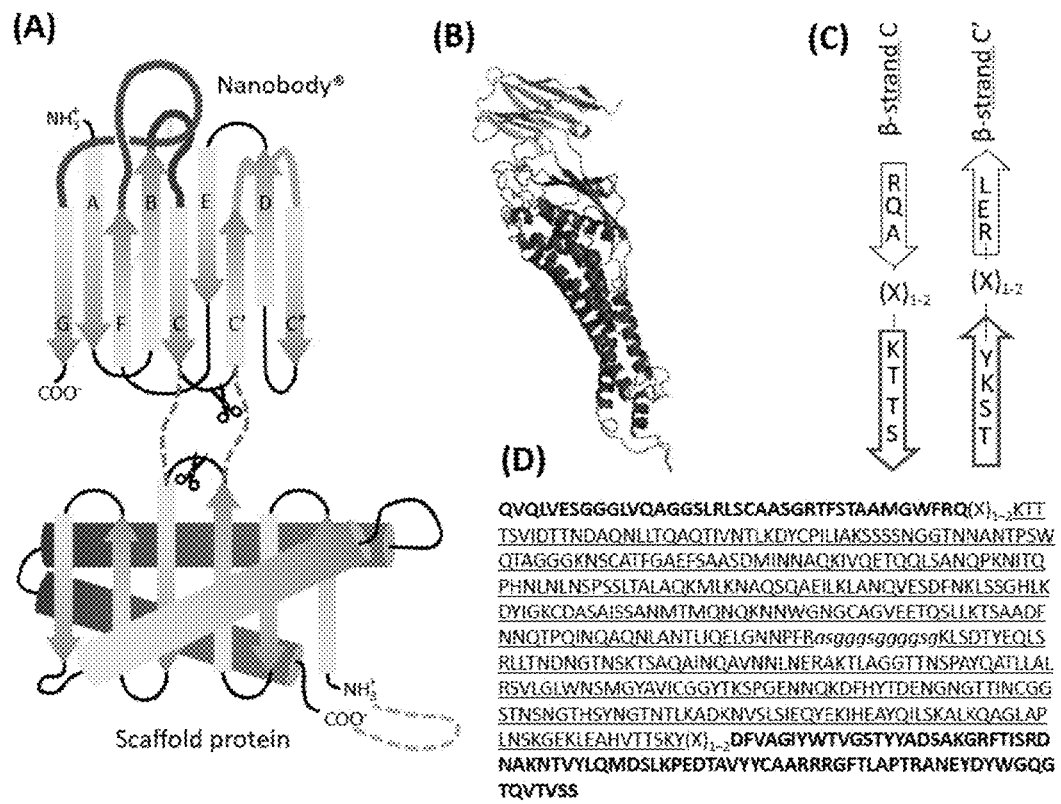

FIG. 22. Model of a 58 kD GFP-binding chimeric protein built from a circularly permutated variant of HopQ inserted into the β-turn connecting β-strands C and C' of a GFP-specific Nanobody.

(A) Engineering principles to graft a scaffold onto a Nanobody via the β-turn connecting β-strands C and C'. Scissors indicate which exposed turns have to be cut in the Nanobody and the scaffold. Dashed lines indicate how the remaining parts of Nanobody and scaffold have to be concatenated by use of peptide bonds or short peptide linkers to build these antigen-binding chimeric proteins. CDRs, framework residues and β-turn regions of the Nb are defined according to IMGT (FIG. 25, adapted from Lefranc, 2014). (B) 3D Model of an antigen-binding chimeric protein made by a fusion of a GFP-specific Nanobody (Top) connected to HopQ (Bottom) via two peptide linkers. (C) The third β-strand of the Nanobody (β-strand C) is followed by the circulated variant of the scaffold, then followed by the β-strands C' to G of the GFP-specific Nanobody. (D) Amino acid sequences of the resulting antigen-binding chimeric proteins. Nb$_{GFP}$207 sequences in bold, (X)$_{1-2}$ is a short peptide linker of variable length (1 or 2 amino acids) and mixed composition, circular permutation linker in italics, HopQ sequences underlined.

Figure 23:
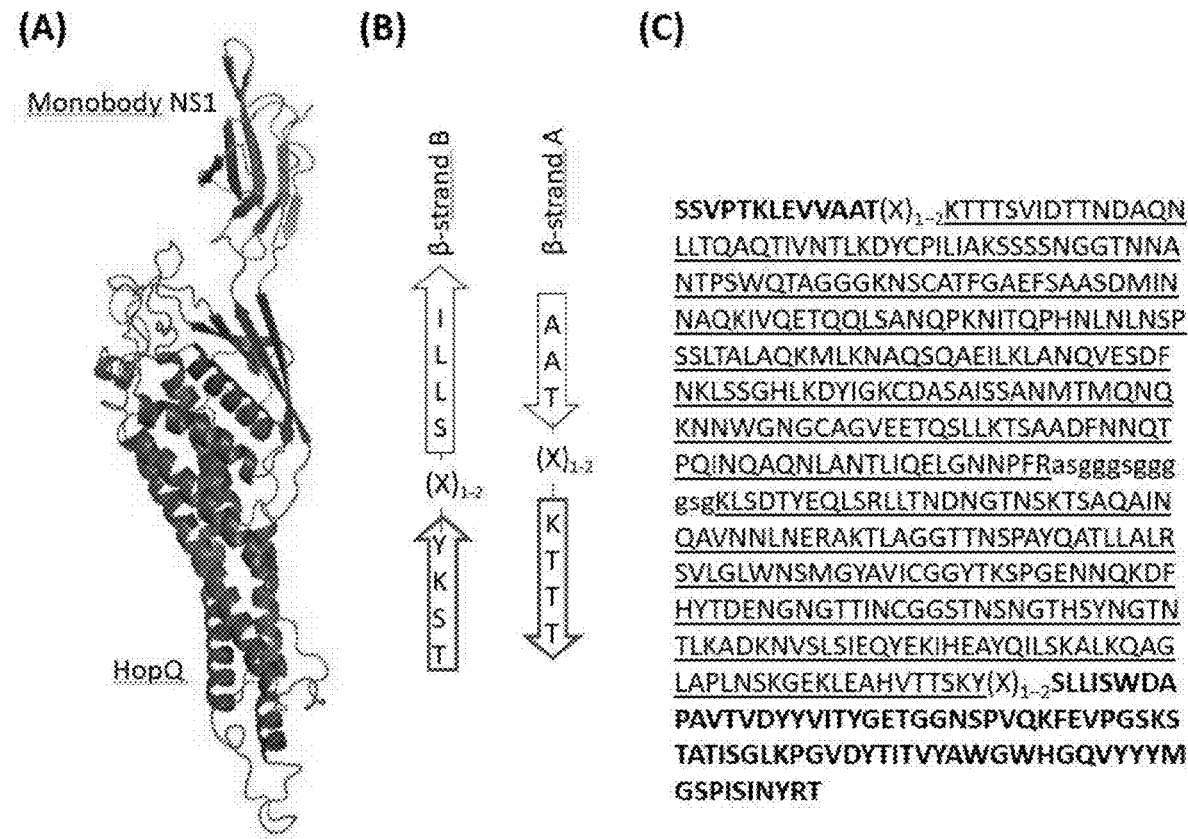

FIG. 23. Model of a 58 kD GFP-binding chimeric protein built from a circularly permutated variant of HopQ inserted into the first β-turn connecting β-strands A and B of Monobody NS1.

(A) Model of an antigen-binding chimeric protein made by fusion of a K-Ras specific Monobody NS1 (top) and a circularly permutated variant of the Adhesin domain of HopQ of *H. pylori* (bottom) via two peptide bonds or linkers that connect Nanobody to scaffold. (B) A circularly permutated gene encoding the Adhesin domain of the type 1 HopQ of *Helicobacter pylori* strain G27 (bottom, PDB 5LP2, SEQ ID NO:19) was inserted in the first β-turn of a K-RAS specific monobody (top, SEQ ID NO:112) connecting β-strand A to β-strand B (β-turn AB). (C) Amino acid sequences of antigen-binding chimeric proteins built from NS1 and HopQ. Sequences originating from the Nanobody are depicted in bold. Sequences originating from HopQ are underlined. The peptide linking the N-terminus and the C-terminus of the HopQ to make a circular permutant is depicted in italics, $(X)_{1-2}$ is a short peptide linker of variable length (1 or 2 amino acids) and mixed composition.

FIG. 24. Kinetic characterization of the interaction of antigen-binding chimeric protein $Mb_{Nb207}^{cHopQ}$ and $Mb_{Nb207}^{cYgjkE2}$ with GFP analyzed on Octet.

Real-time kinetic analysis of GFP-binding Nanobody $Nb_{GFP}207$ (SEQ ID NO:1), antigen-binding chimeric protein $Mb_{Nb207}^{cHopQ}$ (SEQ ID NO:20) and $Mb_{Nb207}^{cYgjkE2}$ (SEQ ID NO:141) with GFP by bio-layer interferometry. Streptavidin-coated Octet® biosensors were used to capture biotinylated GFP (0.75 μg/mL) and associated with several concentrations (60-2.22 nM range) of $Nb_{GFP}207$ (A), $Mb_{Nb207}^{cHopQ}$ (B) and $Mb_{Nb207}^{cYgjkE2}$ (C). The measured responses (black lines) were fitted to a monophasic 1:1 binding model (red lines). The assays were run in 10 mM Tris-HCl, 140 mM NaCl, pH 7.3, 0.05% $Tween_{20}$ and 1 mg/mL BSA. (D) Calculated kinetic values are shown as mean standard error of the mean (s.e.m.) from n=3 independent experiments.

FIG. 25. Immunoglobulin variable domain structure and topology according to IMGT, as adapted from LeFranc (2014).

(A) 3D structure ribbon representation with the IMGT strand and loop delimitations (LFranc et al., 2003). (B) IMGT Collier de Perles on two layers with hydrogen bonds. The IMGT Collier de Perles on two layers show, in the forefront, the GFCC'C"strands (forming the sheet located at the interface VH/VL of the IG) and, in the back, the ABED strands. The IMGT Collier de Perles with hydrogen bonds (green lines on line, only shown here for the GFCCOC00 sheet) is generated by the IMGT/Collier-de-Perles tool integrated in IMGT/3Dstructure-DB, from experimental 3D structure data (Kaas et al., 2004; Ehrenmann et al., 2010, Ehrenmann and LeFranc, 2011).

FIG. 26. Schematic representation of antigen-binding chimeric proteins that bind to and extend other antigen-binding chimeric proteins.

(A) $Mb_{Nb60}^{cHopQ}$mut2 (SEQ ID NO:134) or $Mb_{Nb60}^{cHopQ}$mut3 (SEQ ID NO:134) binds to and extends another $Mb_{Nb207}^{cHopQ}$ (SEQ ID NO:20) to generate an extended antigen-binding chimeric protein of 116 kDa. (B) $Mb_{Nb60}^{cY9jK}$(SEQ ID NO:135) binds to and extends $Mb_{Nb207}^{cHopQ}$ (SEQ ID NO:20), to generate an extended antigen-binding chimeric protein of a molecular weight of 168 kDa.

FIG. 27. Crystal structure of Nb60 in complex with $Mb_{Nb207}^{cHopQ}$ revealing the epitope of Nb60 on the scaffold protein contained in cHopQ of $Mb_{Nb207}^{cHopQ}$ FIG. 28. Schematic representation of an antigen-binding chimeric protein, with the antigen-binding domain linked to the scaffold protein using integrated chemical linker units.

FIG. 29. Kinetic characterization of the interaction of antigen-binding chimeric proteins called Polybodies with $Mb_{Nb207}^{cHopQ}$ analyzed on Octet.

Real-time kinetic analysis of the binding of the HopQ-specific Nanobody Nb60 (SEQ ID NO:132), the HopQ-specific $Mb_{Nb60}^{cHopQ}$mut2 (SEQ ID NO:133), the HopQ-specific $Mb_{Nb60}^{cHopQ}$mut3 (SEQ ID NO:134) and the HopQ-specific $Mb_{Nb60}^{cYgjkE2}$ (SEQ ID NO:135) to $Mb_{Nb207}^{cHopQ}$ (SEQ ID NO:20) by bio-layer interferometry. Streptavidin-coated Octet® biosensors were used to capture biotinylated $Mb_{Nb207}^{cHopQ}$ (0.25 μg/mL). Binding and dissociation isotherms at several concentrations (1.67 to 500 nM range) were monitored for Nb60 (A), $Mb_{Nb60}^{cHopQ}$mut2 (B), $Mb_{Nb60}^{cHopQ}$mut3 (C) and $Mb_{Nb60}^{cYgjkE2}$ (D). All assays were run in 10 mM Tris-HCl, 140 mM NaCl, pH 7.3, 0.05% $Tween_{20}$ and 1 mg/mL BSA.

FIG. 30. Flow cytometric analysis of the functionality of $Mb_{Nb207}^{cHopQ}$ variants that are displayed on the surface of EBY100 yeast cells.

$Mb_{Nb207}^{cHopQ}$ (SEQ ID NO:22) and the representative of yeast-display selected $Mb_{Nb207}^{cHopQ}$ variants (Table 2) were displayed on EBY100 cells as Aga2p and ACP fusions. Individual yeast clones were separately induced and orthogonally stained with CoA-647 (2 μM) using the SFP synthase (1 μM) and incubated with 100 nM GFP. Dot plot representation of the relative fluorescence intensity of individual EBY100 yeast cells transformed with a pCTCON2 derivative encoding the MP1331_A9 Megabody variant (A) and $Mb_{Nb207}^{cHopQ}$ (B). Mean fluorescence intensity (MFI) of relative CoA-647 fluorescence (Megabody display level) and relative GFP fluorescence (GFP binding) were calculated for each individual yeast clone using Prism 7 software (GraphPad). (C) Chart representation of the calculated mean fluorescence intensities (MFI) of relative CoA-647 and GFP fluorescence for the $Mb_{Nb207}^{cHopQ}$ (SEQ ID NO:22) and each individual $Mb_{Nb207}^{cHopQ}$ variant (Table 2).

FIG. 31. Size exclusion chromatography characterization of $Mb_{Nb207}^{cHopQ}$ and four yeast-display selected $Mb_{Nb207}^{cHopQ}$ variants after *E. coli* expression and nickel affinity chromatography purification.

Preparative gel filtration experiments on a Superdex 200 PG column (10/300, GE Healthcare) of *E. coli* expressed $Mb_{Nb207}^{cHopQ}$ variants with 1-1 amino acid peptide linkers selected by yeast display. $Mb_{Nb207}^{cHopQ}$ (SEQ ID NO: 136) clone represents the wild type connection variant and $Mb_{Nb207}^{cHopQ}$A5 (SEQ ID NO: 137), $Mb_{Nb207}^{cHopQ}$A12 (SEQ ID NO: 138), $Mb_{Nb207}^{cHopQ}$B7 (SEQ ID NO: 139), $Mb_{Nb207}^{c7HopQ}$G10 (SEQ ID NO: 140) represent MP1331_A5, MP1331_A12, MP1331_B7, MP1331_G10 clones from Table 2 respectively.

FIG. 32. GFP binding analysis of the $Mb_{Nb207}^{cHopQ}$ and four yeast-display selected variants by ELISA.

Size-exclusion purified $Mb_{Nb207}^{cHopQ}$ (SEQ ID NO: 136), four yeast-display selected $Mb_{Nb207}^{c7HopQ}$A5, $Mb_{Nb207}^{c7HopQ}$A12, $Mb_{Nb207}^{cHopQ}$B7, $Mb_{Nb207}^{c7HopQ}$G10 variants (SEQ ID NO: 137-140) and $Mb_{Nb38}^{cHopQ}$ (SEQ ID NO: 131), were incubated with on wells containing immobilized GFP or non-coated wells. The EPEA-tag that is present on the C-terminus of the Megabodies was detected using a biotinylated anti-EPEA (Capture select C-tag) antibody mixed with a Streptavidin-Alkaline conjugate. Absorbance at 405 nm ($OD_{405}$) was measured after incubation with 4-nitrophenyl phosphate disodium salt hexahydrate substrate (DNPP). The data is shown as mean standard error of the mean (s.e.m.) from the experiment performed in triplicates (n=3).

Figure 33:
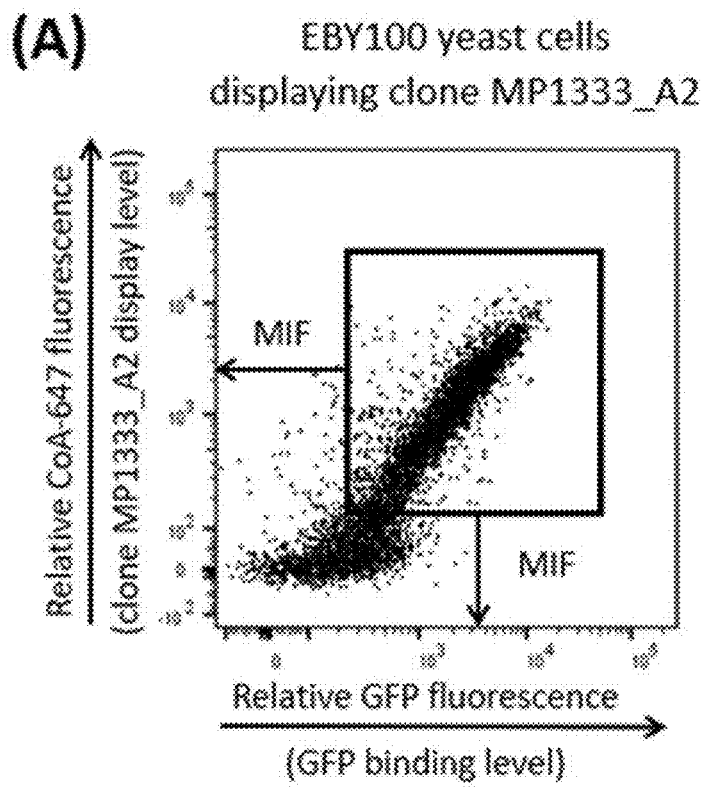
Figure 33:
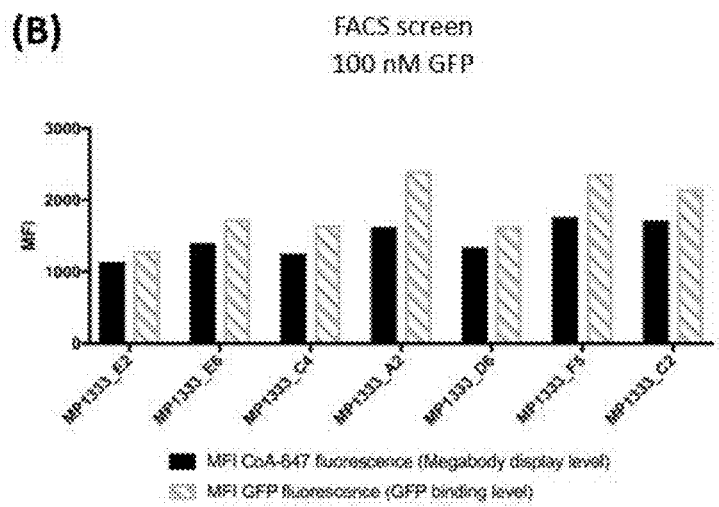

FIG. 33. Flow cytometric analysis of the functionality of $Mb_{Nb207}^{cYgJk}$ variants that are displayed on the surface of EBY100 yeast cells.

The representatives of yeast-display selected $Mb_{Nb207}^{cYgjk}$ variants (Table 3) were displayed on EBY100 cells as Aga2p and ACP fusions. Individual yeast clones were separately induced and orthogonally stained with CoA-647 (2 µM) using the SFP synthase (1 µM) and incubated with 100 nM GFP. (A) Dot plot representation of the relative fluorescence intensity of individual EBY100 yeast cells transformed with a pCTCON2 derivative encoding the MP1333_A2 Megabody variant. Mean fluorescence intensity (MFI) of relative CoA-647 fluorescence (Megabody display level) and relative GFP fluorescence (GFP binding) were calculated for each individual yeast clone using Prism 7 software (GraphPad). (B) Chart representation of the calculated mean fluorescence intensities (MFI) of relative CoA-647 and GFP fluorescence for each individual $Mb_{Nb207}^{cYgjk}$ variants (Table 3).

Figure 34:
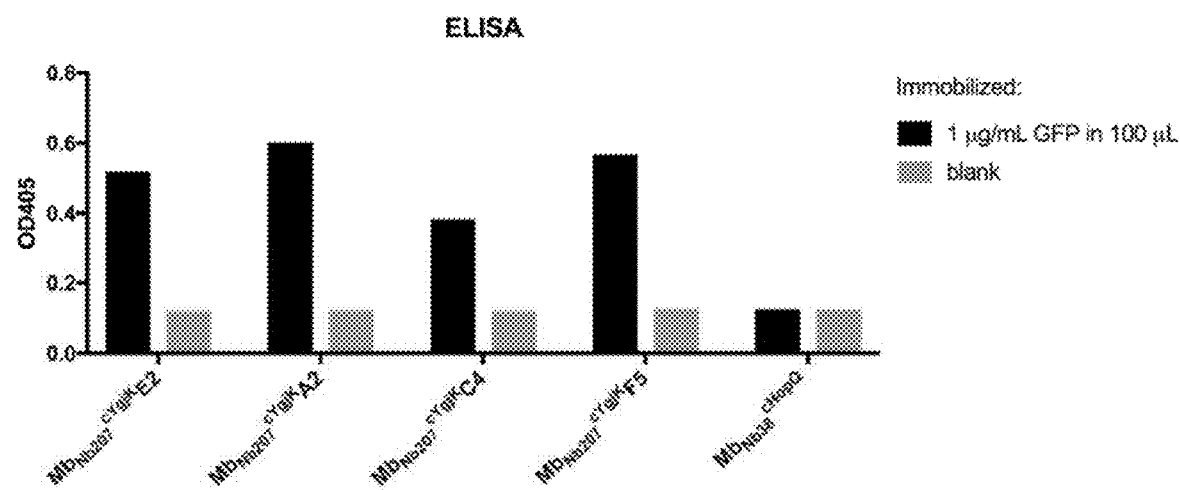

FIG. 34. GFP binding of four yeast-display selected $Mb_{Nb207}^{cYgjk}$ variants, analysed by ELISA.

Periplasmic extracts containing different $Mb_{Nb207}^{cYgjk}$ variants (SEQ ID NO:141-144): $Mb_{Nb207}^{cYgjk}E2$ $Mb_{Nb207}^{cYgjk}A2$, $Mb_{Nb207}^{cYgjk}C4$, $Mb_{Nb207}^{cYgjk}F5$ variants were compared to $Mb_{Nb38}^{cHopQ}$ (SEQ ID NO: 131). All samples were incubated on wells containing immobilized GFP or non-coated wells. The EPEA-tag that is present on the C-terminus of the Megabodies was detected using a biotinylated anti-EPEA (Capture select C-tag) antibody mixed with a Streptavidin-Alkaline conjugate. Absorbance at 405 nm ($OD_{405}$) was measured after incubation with 4-nitrophenyl phosphate disodium salt hexahydrate substrate (DNPP).

Figure 35:
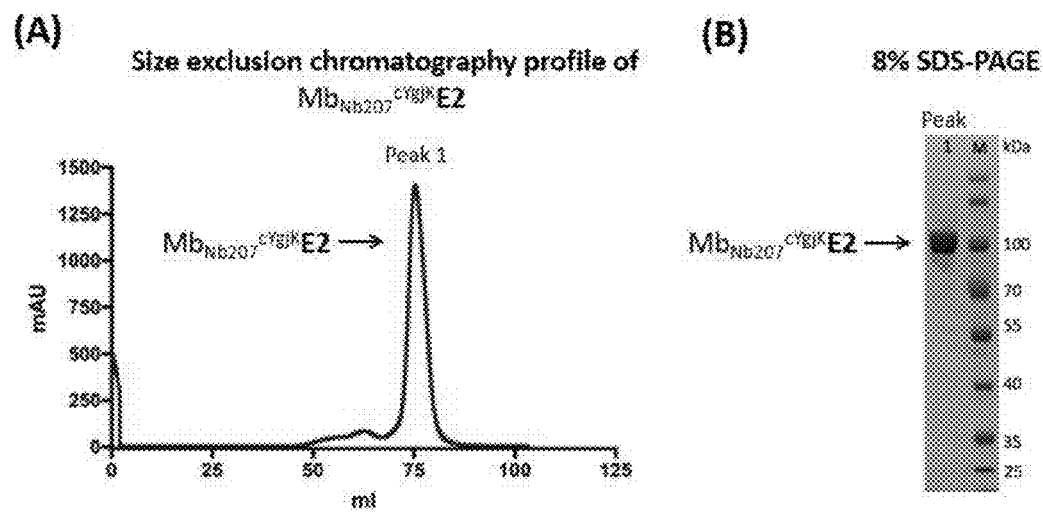

FIG. 35. Characterization of the $Mb_{Nb207}^{cYgjk}E2$ variant expressed in *E. coli* and purified by nickel affinity chromatography by size exclusion chromatography.
- (A) Analysis of $Mb_{Nb207}^{cYgjk}E2$ (SEQ ID NO:141) expressed in periplasm of *E. coli* and purified by nickel affinity chromatography on a preparative Superdex 200 PG gel filtration column (16/26, GE Healthcare).
- (B) SDS-PAGE analysis of the purity of $Mb_{Nb207}^{cYgjk}E2$ Megabody in the fraction 'Peak 1' from size exclusion experiment described in (A). A sample of the purified $Mb_{Nb207}^{cYgjk}E2$ (left line: 'Peak 1) was applied to a 8% SDS-PAGE gel and the molecular mass of about 100 kDa was confirmed by comparison to a molecular mass marker (right line: M).

Figure 36A:
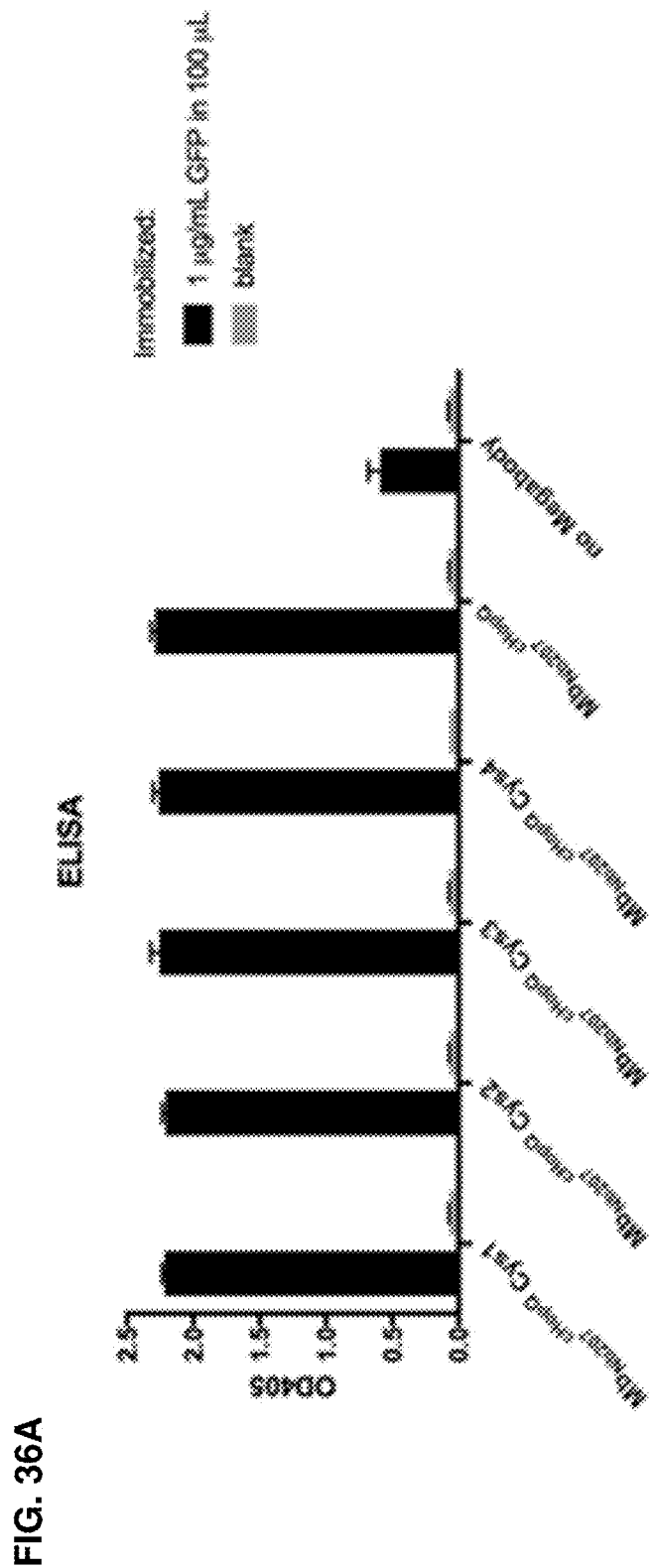
Figure 36B:
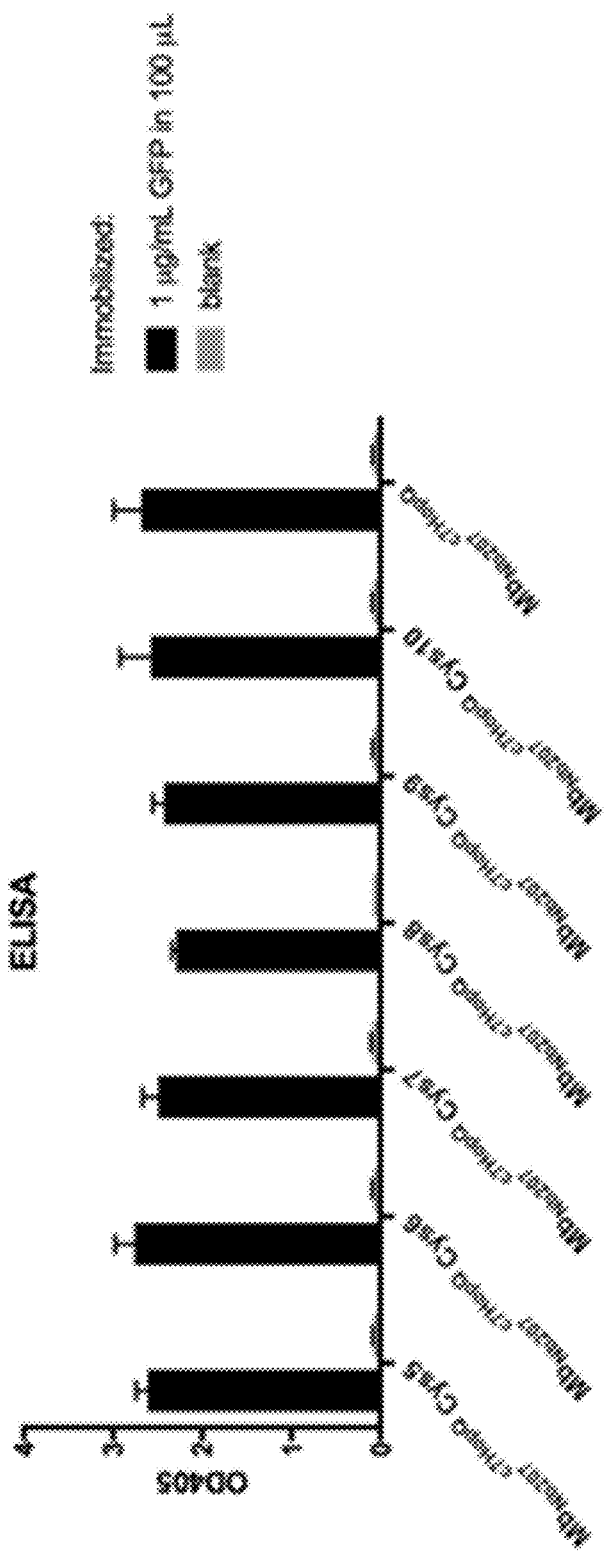
Figure 36C:
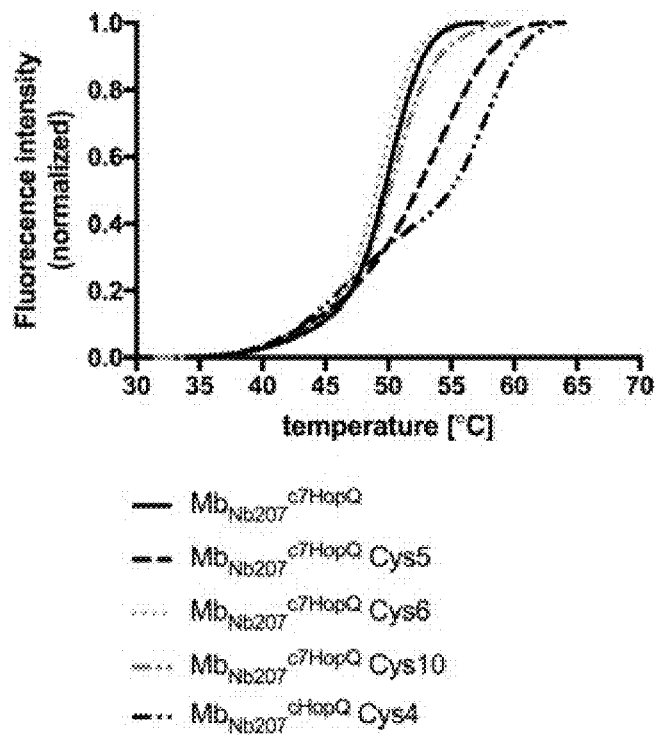

FIG. 36. Functional and biophysical characterisation of $Mb_{Nb207}^{cHopQ}$ variants that were further rigidified by an engineered disulphide bond that connects Nanobody to scaffold.

GFP binding analysis of ten $Mb_{Nb207}^{cHopQ}$ variants was analyzed by ELISA. (A) Size-exclusion purified $Mb_{Nb207}^{cHopQ}$ (SEQ ID NO:20) and four $Mb_{Nb207}^{cHopQ}$ Cys1-4 variants (SEQ ID NO:48-51, see FIG. 10) were incubated on wells containing immobilized GFP or non-coated wells. (B) Size-exclusion purified $Mb_{Nb207}^{cHopQ}$ (SEQ ID NO:136) and four $Mb_{Nb207}^{cHopQ}$ Cys5-10 variants (SEQ ID NO:145-150) were incubated on wells containing immobilized GFP or non-coated wells. The EPEA-tag that is present on the C-terminus of the Megabodies was detected using a biotinylated anti-EPEA (CaptureSelect C-tag) antibody mixed with a Streptavidin-Alkaline conjugate. Absorbance at 405 nm ($OD_{405}$) was measured after incubation with 4-nitrophenyl phosphate disodium salt hexahydrate substrate (DNPP). The data are shown as mean standard error of the mean (s.e.m.) from the experiment performed in triplicates (n=3). (C) Thermostablity analysis of $Mb_{Nb207}^{cHopQ}$ variants was performed by a thermal shift assay (TSA). Chart representation of the normalized melting profiles for $Mb_{Nb207}^{cHopQ}$ (SEQ ID NO: 136), $Mb_{Nb207}^{cHopQ}$ Cys4 (SEQ ID NO: 51), $Mb_{Nb207}^{c7HopQ}$Cys5 (SEQ ID NO:145), $Mb_{Nb207}^{cHopQ}$ Cys6 (SEQ ID NO:146) and $Mb_{Nb207}^{cHopQ}$ Cys10 (SEQ ID NO:150) variants. Calculated melting temperature (Tm) values are listed in Table 4.

Figure 37:
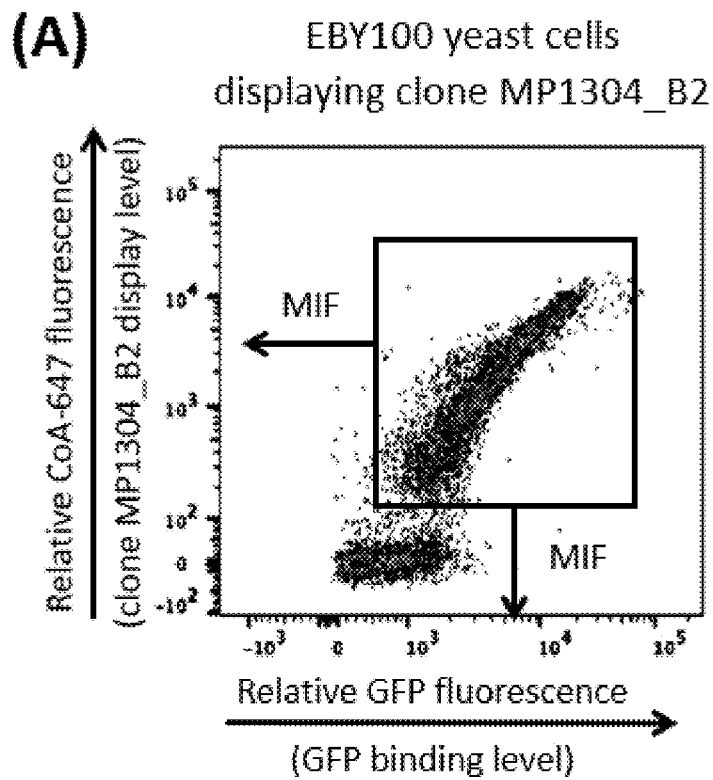
Figure 37:
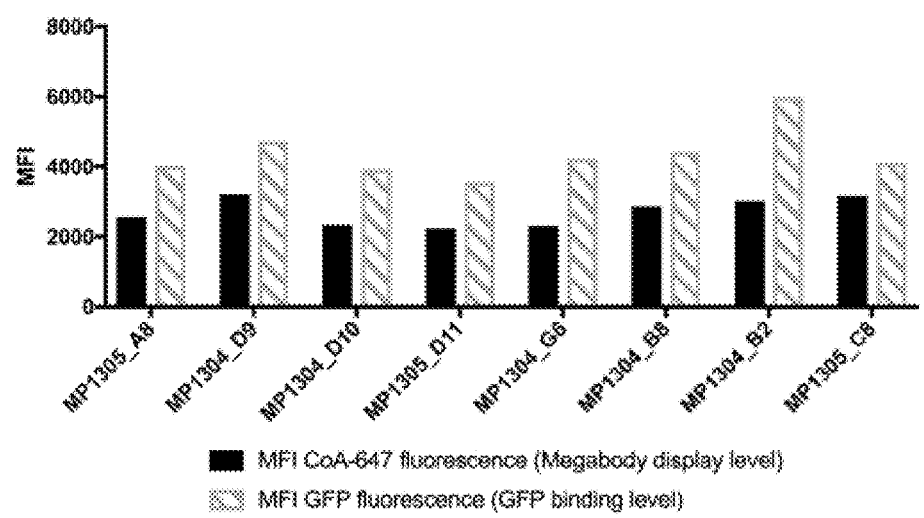

FIG. 37. Flow cytometric analysis of the functionality of $Mb_{Nb207}^{Azurin}$ variants that are displayed on the surface of EBY100 yeast cells.

The representatives of yeast-display selected $Mb_{Nb207}^{Azurin}$ variants (Table 5) were displayed on EBY100 cells as Aga2p and ACP fusions. Individual yeast clones were separately induced and orthogonally stained with CoA-647 (2 µM) using the SFP synthase (1 µM) and incubated with 100 nM GFP. (A) Dot plot representation of the relative fluorescence intensity of individual EBY100 yeast cells transformed with a pCTCON2 derivative encoding the MP1304_B2 Megabody variant. Mean fluorescence intensity (MFI) of relative CoA-647 fluorescence (Megabody display level) and relative GFP fluorescence (GFP binding) were calculated for each individual yeast clone using Prism 7 software (GraphPad). (B) Chart representation of the calculated mean fluorescence intensities (MFI) of relative CoA-647 and GFP fluorescence for each individual $Mb_{Nb207}^{Azurin}$ variants (Table 5).

Figure 38:
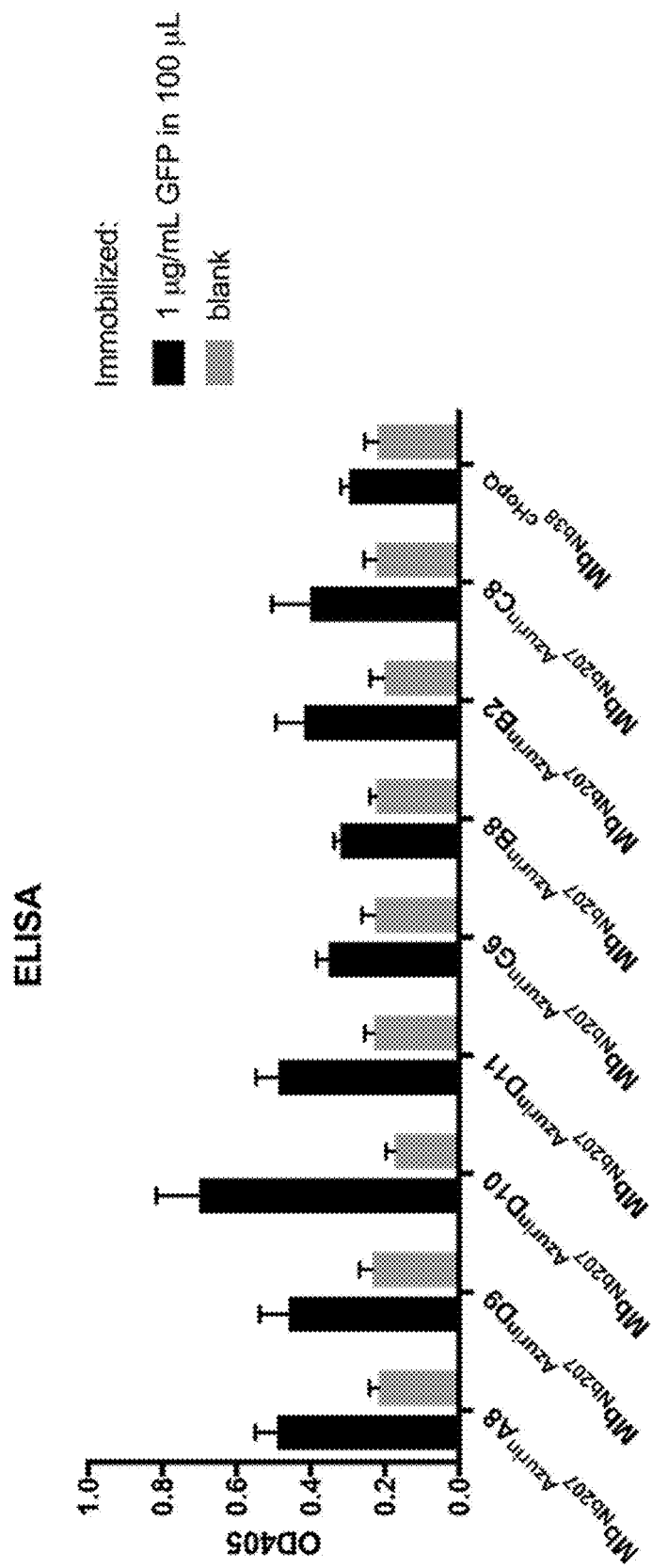

FIG. 38. GFP binding analysis of eight yeast-display selected $Mb_{Nb207}^{Azurin}$ variants by ELISA.

Eight periplasmic extracts containing different $Mb_{Nb207}^{Azurin}$ variants (SEQ ID NO:151-158) and one extract containing $Mb_{Nb38}^{cHopQ}$ (SEQ ID NO: 131), were incubated on wells containing immobilized GFP or non-coated wells. The EPEA-tag that is present on the C-terminus of the Megabodies was detected using a biotinylated anti-EPEA (CaptureSelect C-tag) antibody mixed with a Streptavidin-Alkaline conjugate. Absorbance at 405 nm ($OD_{405}$) was measured after incubation with 4-nitrophenyl phosphate disodium salt hexahydrate substrate (DNPP). The data is shown as mean standard error of the mean (s.e.m.) from the experiment performed in triplicates (n=3).

Figure 39:
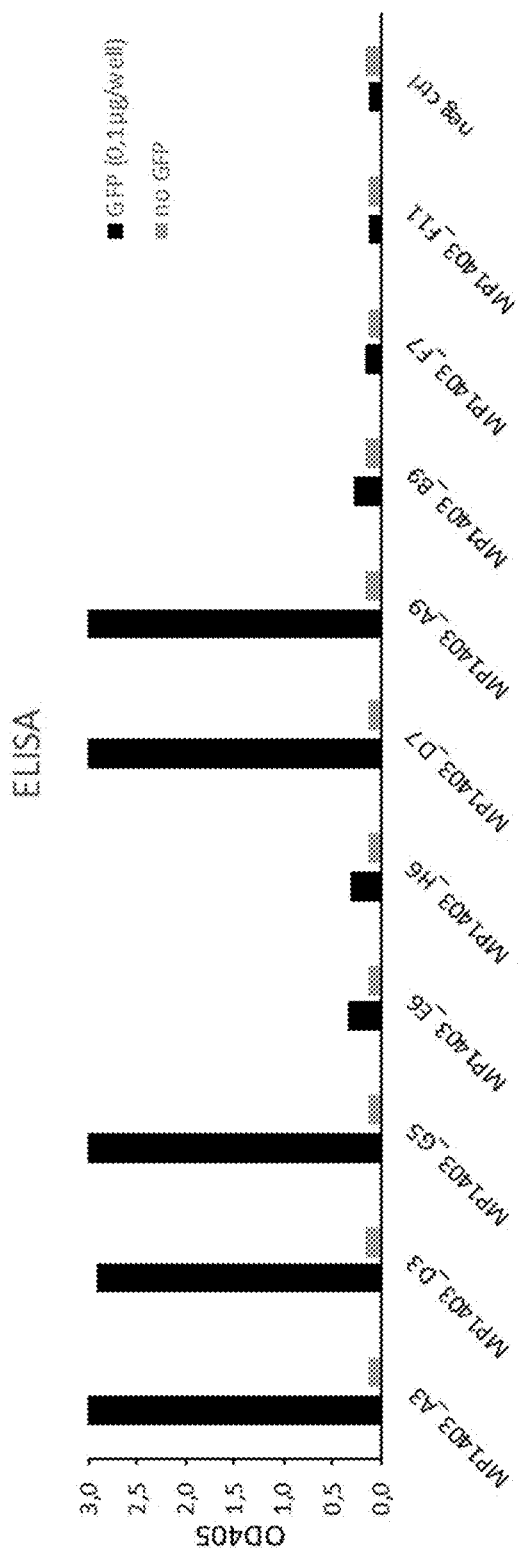

FIG. 39. GFP binding analysis by ELISA

Periplasmic extracts containing different $Mb_{Nb207}^{cPP7x2}L$ chimeric proteins (SEQ ID NO: NO:3-6) were incubated on immobilized GFP (0,1 µg/well) or on noncoated wells. Detection of the EPEA-tag present on C-terminus of the chimeric cPP7 dimer was performed using biotinylated anti-EPEA (CaptureSelect C-tag) antibody mixed with Streptavidin-Alkaline conjugate. Absorbance at 405 nm (OD405) was measured after incubation with 4-nitrophenyl phosphate disodium salt hexahydrate substrate (DNPP).

Figure 40:
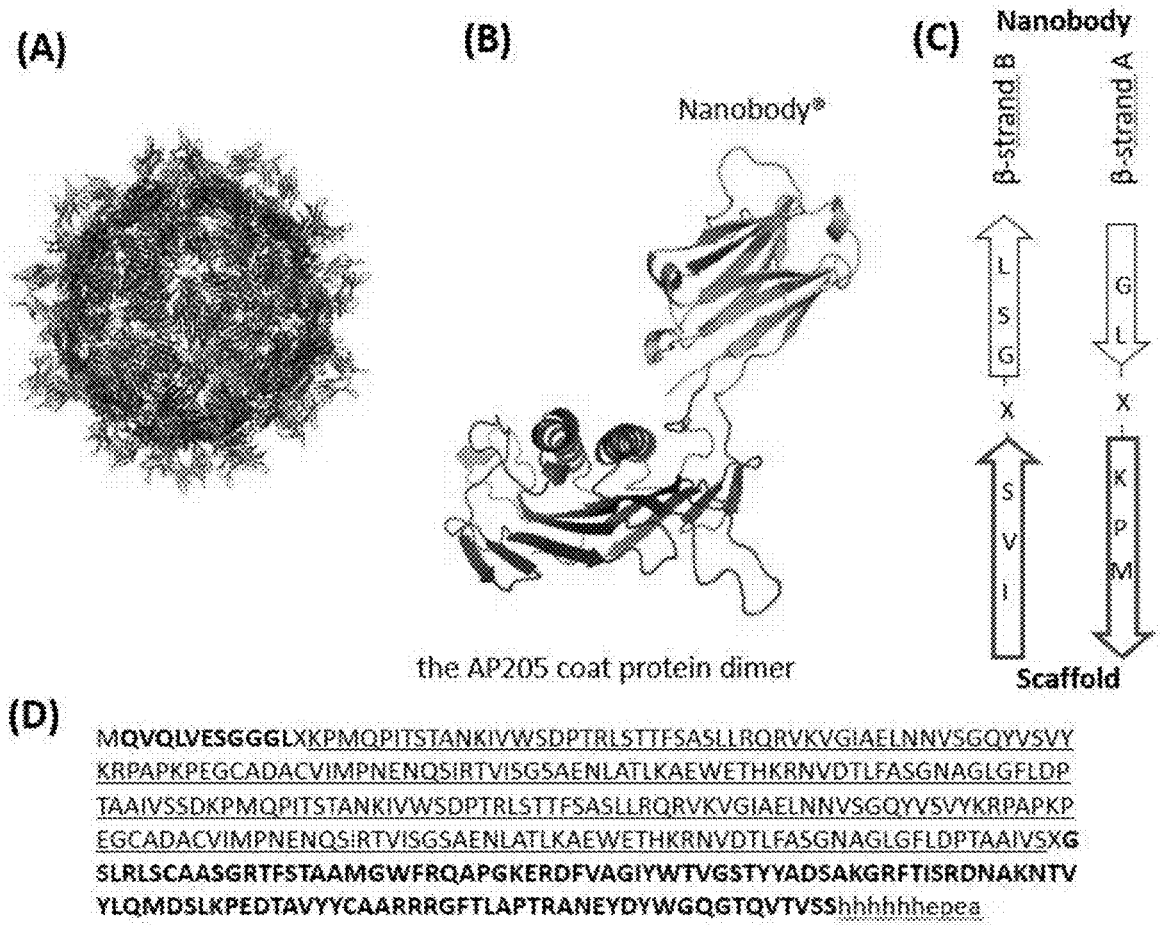

FIG. 40: Riqid display of a Nanobody on Icosahedral VLPs derived from bacteriophage AP205.
(A) Schematic representation of an icosahedral VLP (inner molecules), rigidly displaying 90 copies of a Nanobody (outer molecules) in a regular and rigid array. (B) Model of an antigen-binding chimeric protein comprising a GFP-specific Nanobody (top, SEQ ID NO:1) connected to a covalent coat protein dimer of AP205, an icosahedral RNA bacteriophage of *Acinetobacter* bacteria (bottom, PDB 5FS4). (C) Linking scheme of Nanobody to the coat protein of AP205. (D) Amino acid sequences of the antigen-binding chimeric coat protein SEQ ID NO: 167). Residues originating from the Nanobody are depicted in bold. X is a short random peptide linker of 1 amino acids. Sequences corresponding to the AP205 coat protein are underlined. The C-terminal tag includes 6×His and EPEA.

Figure 41A:
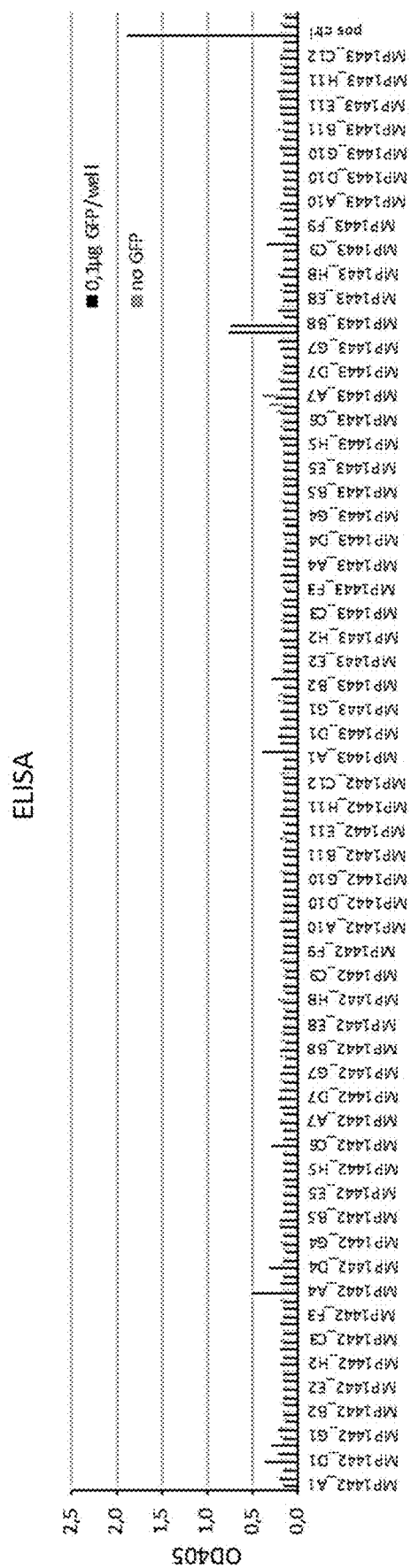
Figure 41B:
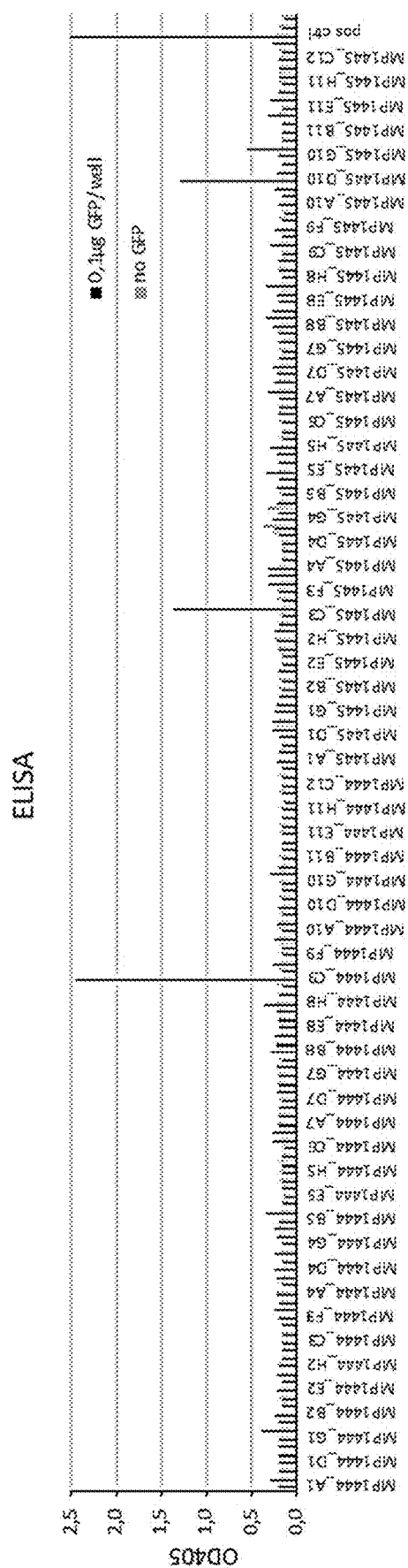

FIG. 41. GFP binding analysis of 372 clones by ELISA

Periplasmic extracts (indicated as MP numbers) containing $Mb_{Nb207}^{AP205x2}XX$ dimers (SEQ ID NO: 167) were incubated on immobilized GFP (0,1 μg/well) or on non-coated wells. Detection of the EPEA-tag present on C-terminus of the chimeric AP205 dimer was performed using biotinylated anti-EPEA (CaptureSelect C-tag) antibody mixed with Streptavidin-Alkaline conjugate. Absorbance at 405 nm ($OD_{405}$) was measured after incubation with 4-nitrophenyl phosphate disodium salt hexahydrate substrate (DNPP).

Figure 42:
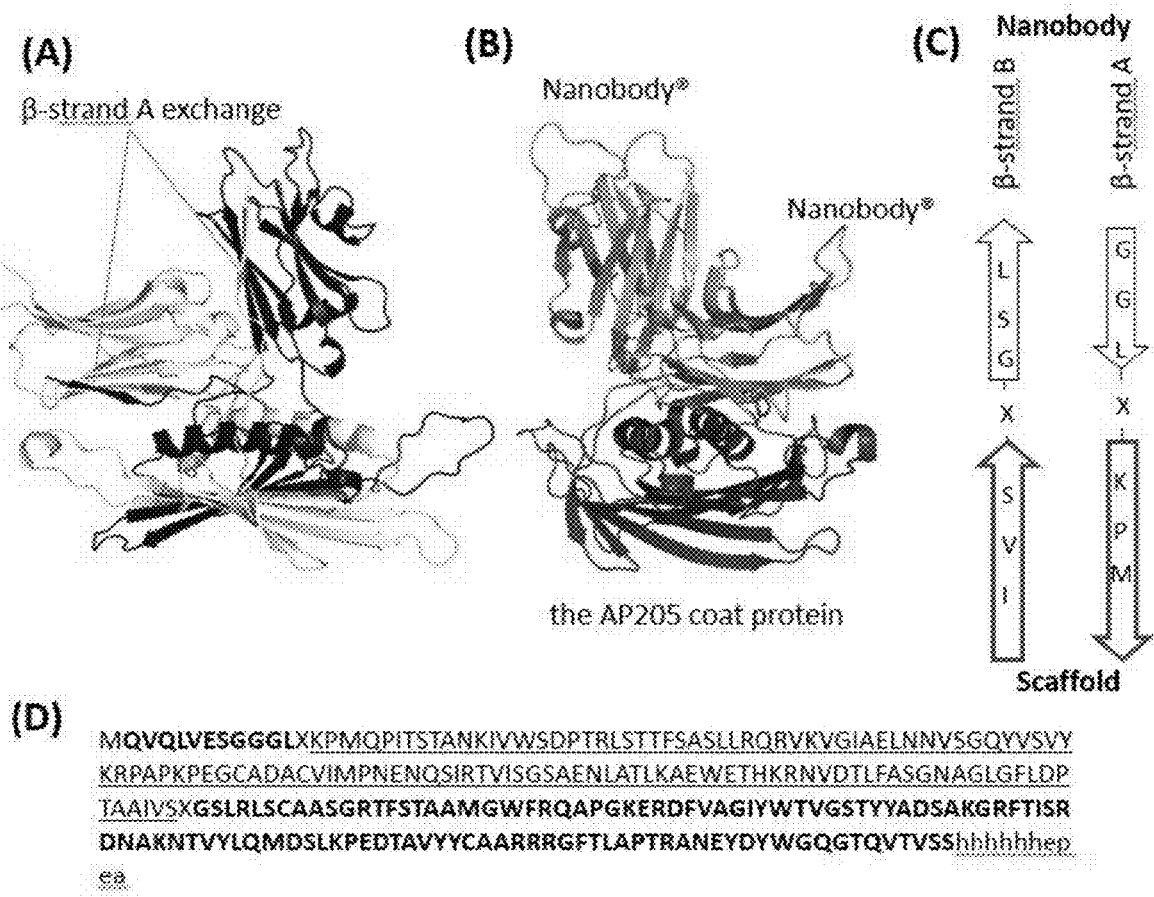

FIG. 42: Riqid display of a Nanobody on a dimeric antigen-binding chimeric protein.

(A) Model of a dimeric antigen binding chimeric protein with β-strand A exchange. The AP205 monomers assemble into dimers. To obtain functional antigen binding chimeras the β-strand A of the GFP-binding Nanobody of a first monomer needs to combine with the β-strands B to G of the GFP-binding Nanobody of a second monomer and the β-strands B to G of the GFP-binding Nanobody of the second monomer needs to combine with β-strand A of the GFP-binding Nanobody of the first monomer to assemble into a dimeric antigen-binding chimeric protein. (B) Model of the same dimeric antigen-binding chimeric protein (turned 90°) comprising two GFP-specific Nanobodies (top, SEQ ID NO:1) each of them connected to a coat protein monomer of AP205. (C) Linking scheme of Nanobody to the coat protein of AP205. (D) Amino acid sequences of the antigen-binding chimeric coat protein (SEQ ID NO: 173). Residues originating from the Nanobody are depicted in bold. X is a short random peptide linker of 1 amino acids. Sequences corresponding to the AP205 coat protein are underlined. The C-terminal tag includes 6×His and EPEA.

Figure 43A:
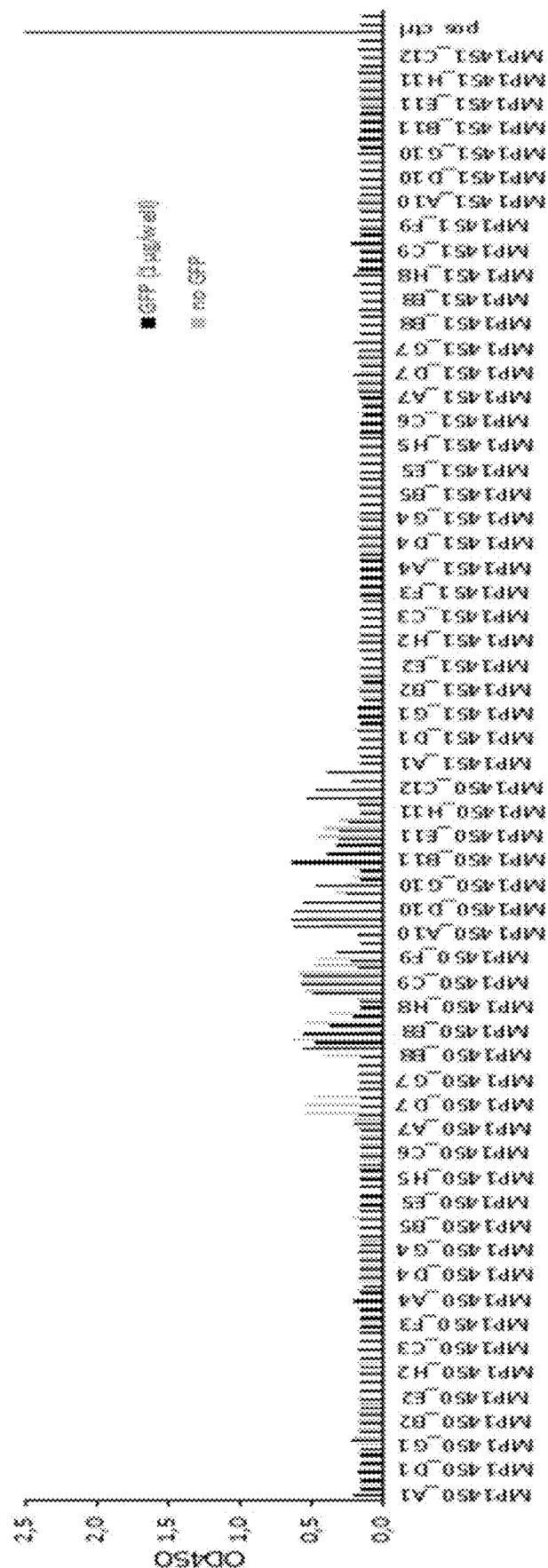
Figure 43B:
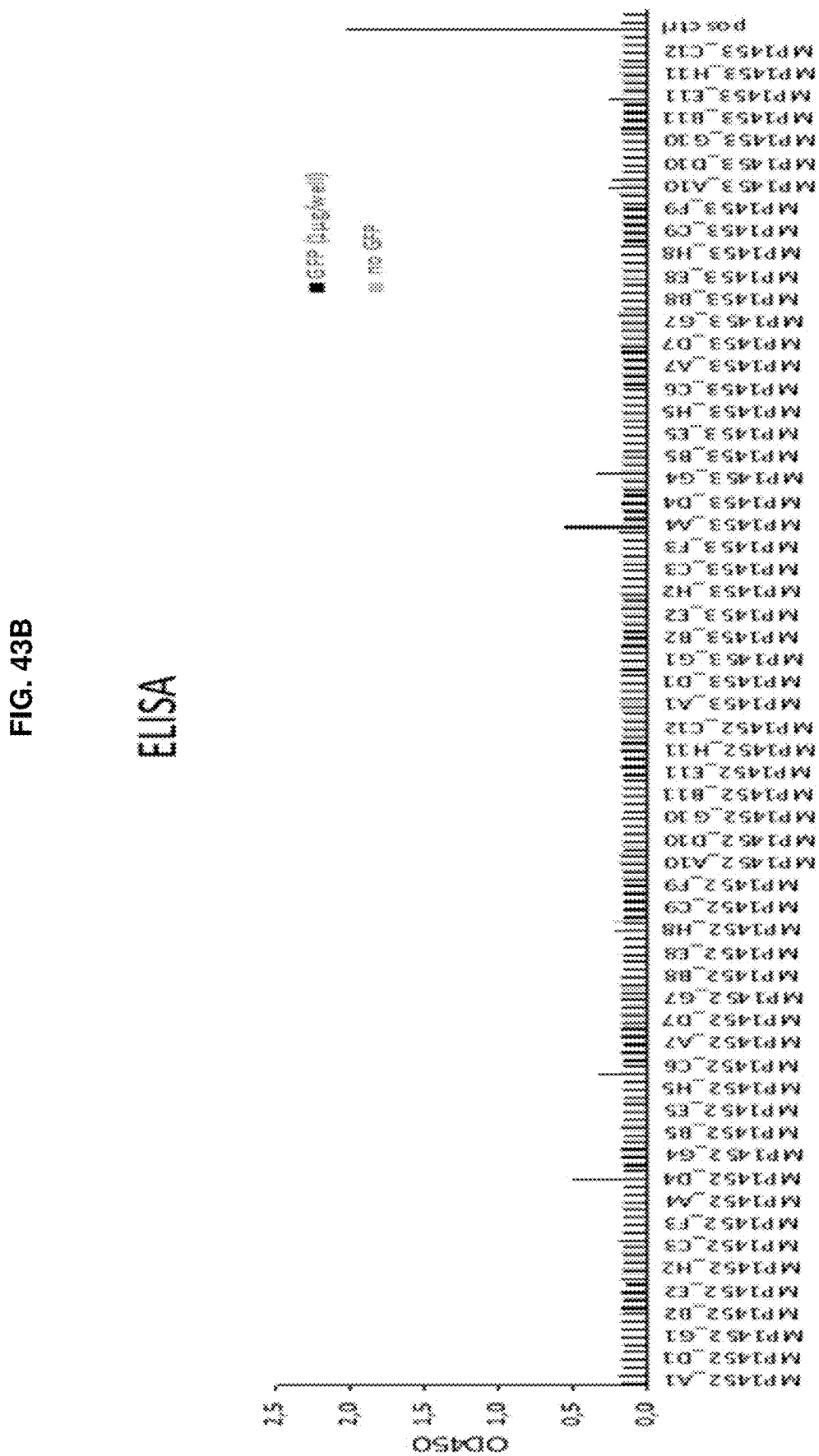

FIG. 43. GFP binding analysis of 372 clones by ELISA

Periplasmic extracts (indicated as MP numbers) containing dimers of $Mb_{Nb207}^{AP205}XX$ (SEQ ID NO: 173) were incubated on immobilized GFP (0,1 μg/well) or on non-coated wells. Detection of EPEA-tag present on C-terminus of the AP205 dimer was performed using biotinylated anti-EPEA antibody (Capture select C-tag) mixed with Strepta-vidin-Alkaline conjugate. Absorbance at 405 nm ($OD_{405}$) was measured after incubation with 4-nitrophenyl phosphate disodium salt hexahydrate substrate (DNPP).

FIG. 44. Flow cytometric analysis of the functionality of $Mb_{Nb207}^{ACP}$ NanoTool variants that are displayed on the surface of EBY100 yeast cells.

The representatives of yeast-display selected $Mb_{Nb207}^{ACP}$ NanoTool variants (Table 9) were displayed on EBY100 cells as Aga2p and ACP fusions. Individual yeast clones were separately induced and orthogonally stained with CoA-647 (2 μM) using the SFP synthase (1 μM) and incubated with 100 nM GFP. (A) Dot plot representation of the relative fluorescence intensity of individual EBY100 yeast cells transformed with a pCTCON2 derivative encoding the MP1302_D10 NanoTool variant. Mean fluorescence intensity (MFI) of relative CoA-647 fluorescence (NanoTool display level) and relative GFP fluorescence (GFP binding) were calculated for each individual yeast clone using Prism 7 software (GraphPad). (B) Chart representation of the calculated mean fluorescence intensities (MFI) of relative CoA-647 and GFP fluorescence for each individual $Mb_{Nb207}^{ACP}$ NanoTool variants (Table 9).

Figure 45:
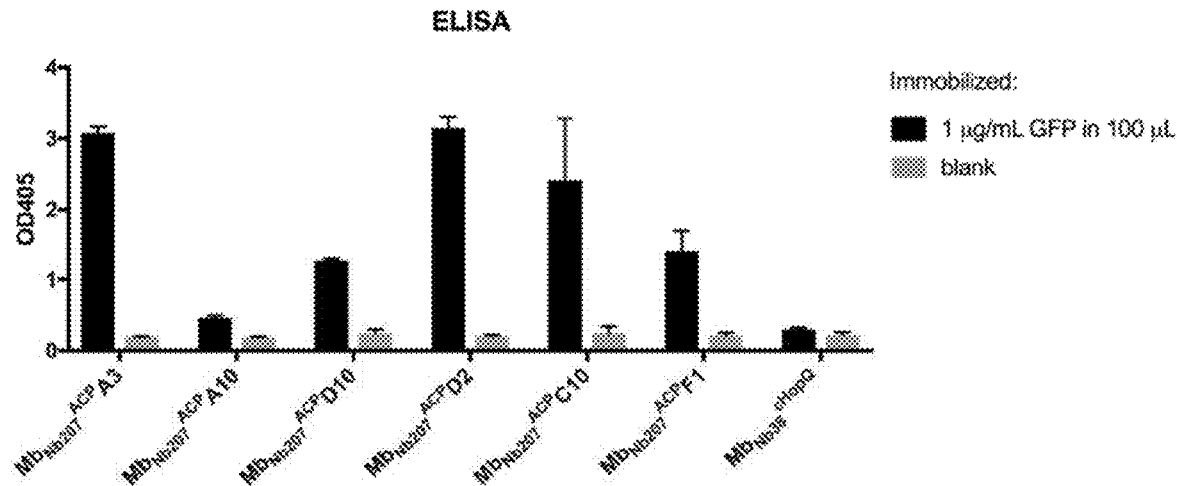

FIG. 45. GFP binding analysis of six yeast-display selected $Mb_{Nb207}^{ACP}$ NanoTool variants by ELISA.

Periplasmic extracts containing six $Mb_{Nb207}^{ACP}$ (SEQ ID NO:178-183) variants and $Mb_{Nb38}^{cHopQ}$ (SEQ ID NO: 131), were incubated on wells containing immobilized GFP or non-coated wells. The EPEA-tag that is present on the C-terminus of the Megabodies was detected using a biotinylated anti-EPEA (Capture select C-tag) antibody mixed with a Streptavidin-Alkaline conjugate.. Absorbance at 405 nm ($OD_{405}$) was measured after incubation with 4-nitrophenyl phosphate disodium salt hexahydrate substrate (DNPP). The data is shown as mean standard error of the mean (s.e.m.) from the experiment performed in triplicates (n=3).

Figure 46:
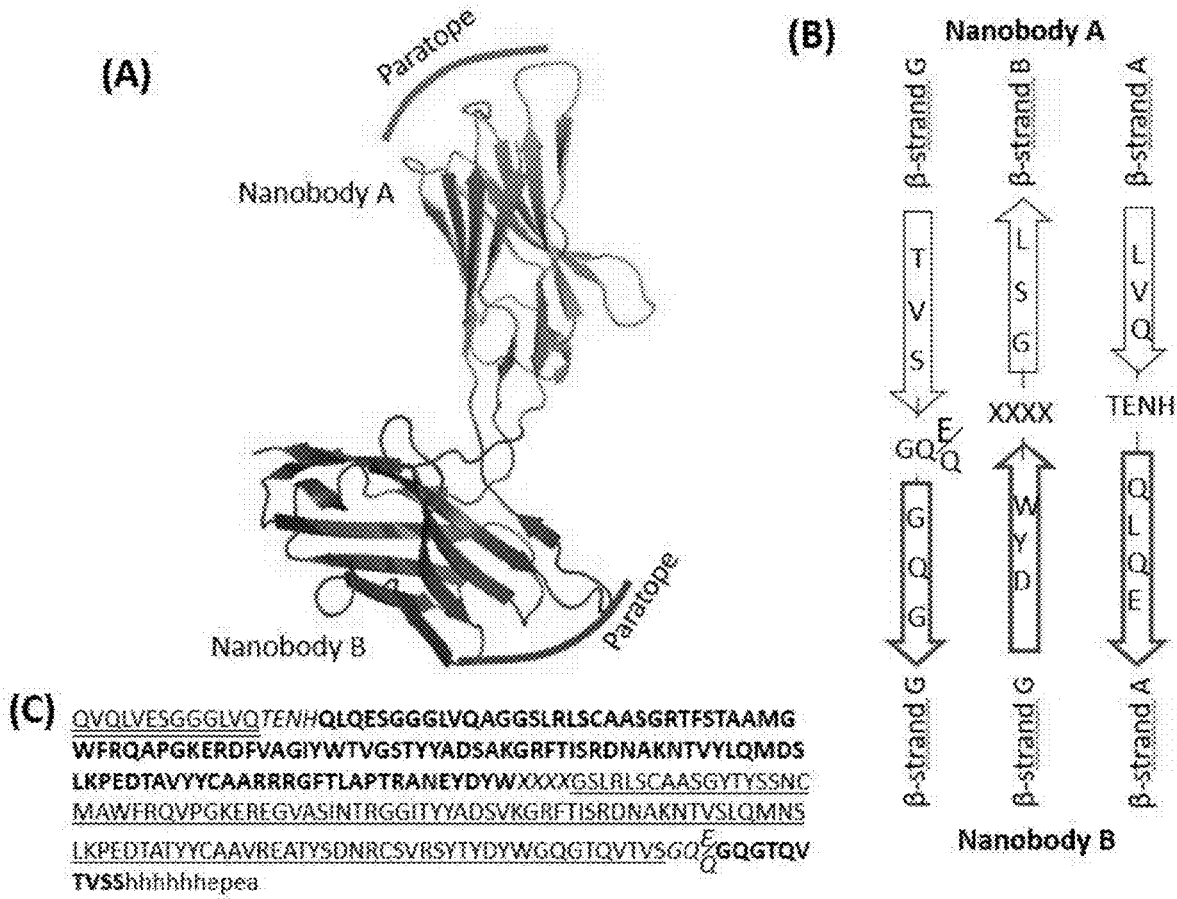

FIG. 46. Model of Nano2bodies antigens-binding chimeric protein.

(A) 3D Model of an energetically better antigen-binding chimeric protein made by a fusion of a GFP-specific Nanobody (Nanobody B, SEQ ID NO:1) connected to a FedF-binding Nanobody (Nanobody A, SEQ ID NO:17), via three peptide linkers according to FIG. 17. (B) Linking scheme of Nanobody A to Nanobody B. (C) Amino acid sequence (SEQ ID NO:184-185) of the resulting antigen-binding chimeric proteins. β-strand A of the GFP-binding Nanobody double underlined, $Nb_{GFP}207$ sequences in bold, FedF-binding Nanobody sequences underlined. The C-terminal tag includes 6×His and EPEA.

Figure 47:
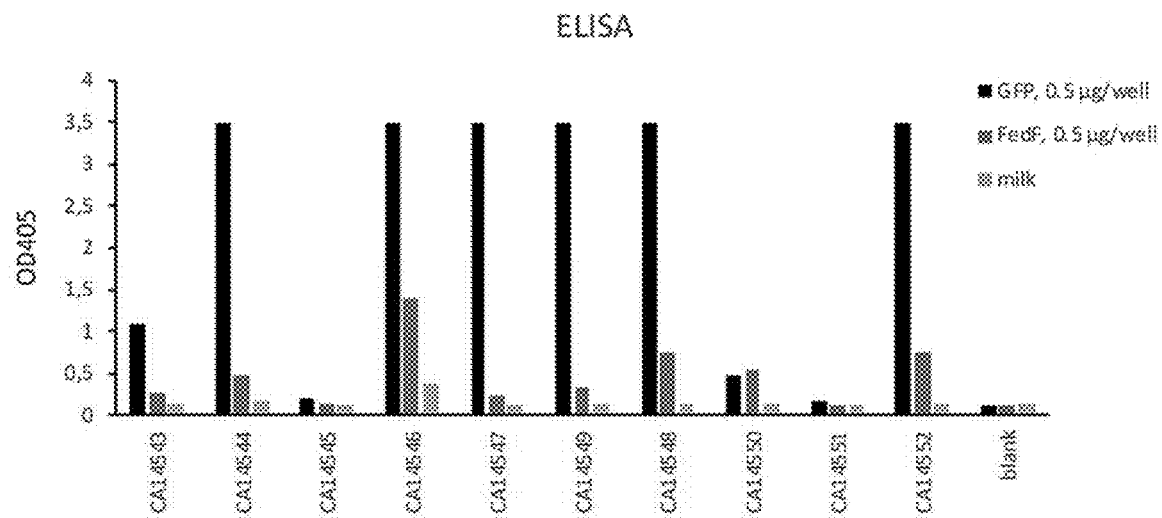

FIG. 47. GFP and FedF binding analysis of representative clones by ELISA

Semi purified N2body samples (SEQ ID NO: 186-191) were incubated on immobilized GFP (0,5 μg/well), on immobilized FedF (0,5 μg/well) or on noncoated wells. Detection of EPEA-tag present on C-terminus of the Nano2bodies was performed using biotinylated anti-EPEA antibody (Capture select C-tag) mixed with Streptavidin-Alkaline conjugate. Absorbance at 405 nm ($OD_{405}$) was measured after incubation with 4-nitrophenyl phosphate disodium salt hexahydrate substrate (DNPP).

Figure 48:
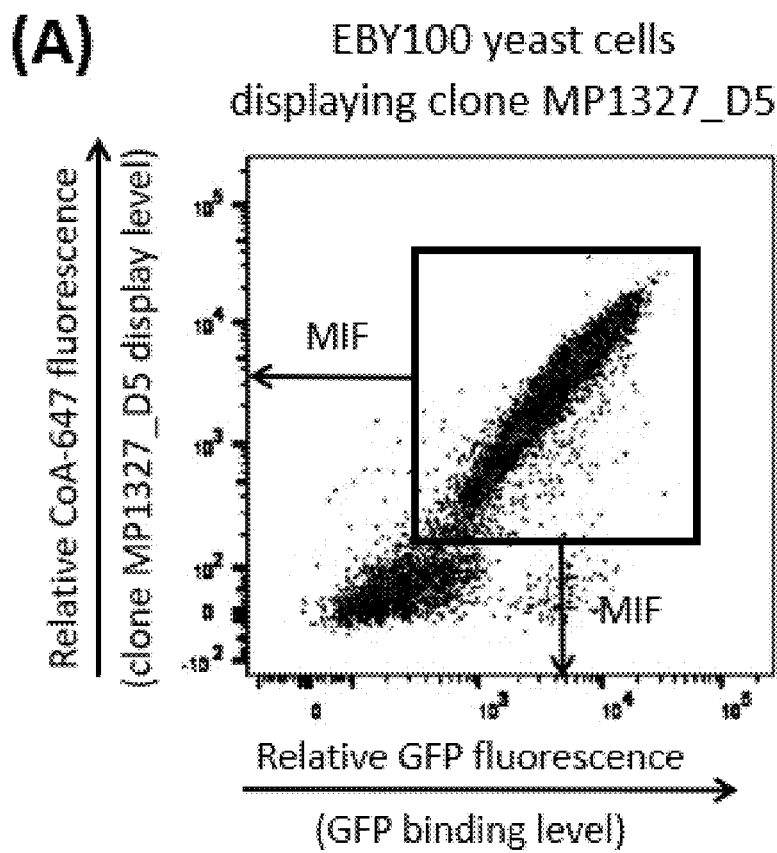
Figure 48:
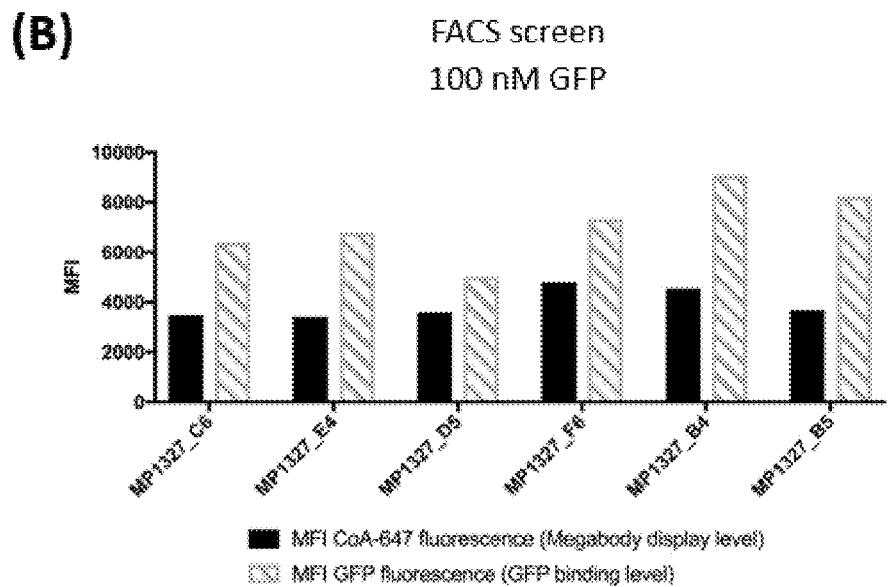

FIG. 48. Flow cytometric analysis of the functionality of $cHopQNb_{GFP}207$ CC' Megabody variants that are displayed on the surface of EBY100 yeast cells.

The representatives of yeast-display selected $cHopQNb_{GFP}207X$ CC' Megabody variants (Table 11) were displayed on EBY100 cells as Aga2p and ACP fusions. Individual yeast clones were separately induced and orthogonally stained with CoA-647 (2 μM) using the SFP synthase (1 μM) and incubated with 100 nM GFP. (A) Dot plot representation of the relative fluorescence intensity of individual EBY100 yeast cells transformed with a pCT-CON2 derivative encoding the MP1327_D5 Megabody variant. Mean fluorescence intensity (MFI) of relative CoA-647 fluorescence (MEgabody display level) and relative GFP fluorescence (GFP binding) were calculated for each individual yeast clone using Prism 7 software (GraphPad). (B) Chart representation of the calculated mean fluorescence intensities (MFI) of relative CoA-647 and GFP fluorescence for each individual $cHopQNb_{GFP}207CC'$ Megabody variants (Table 11).

Figure 49:
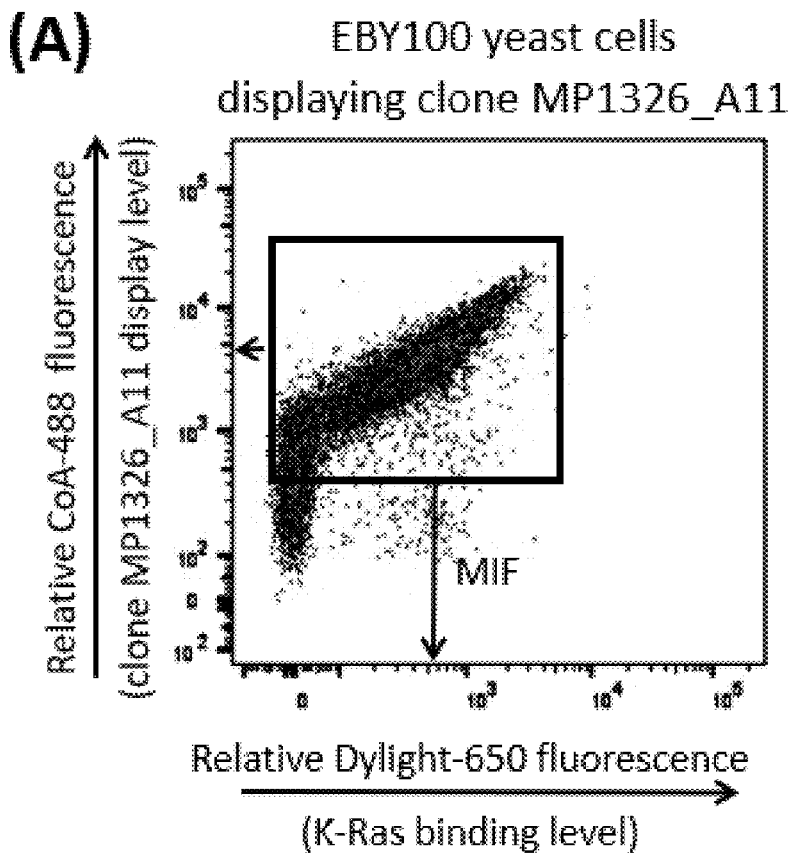
Figure 49:
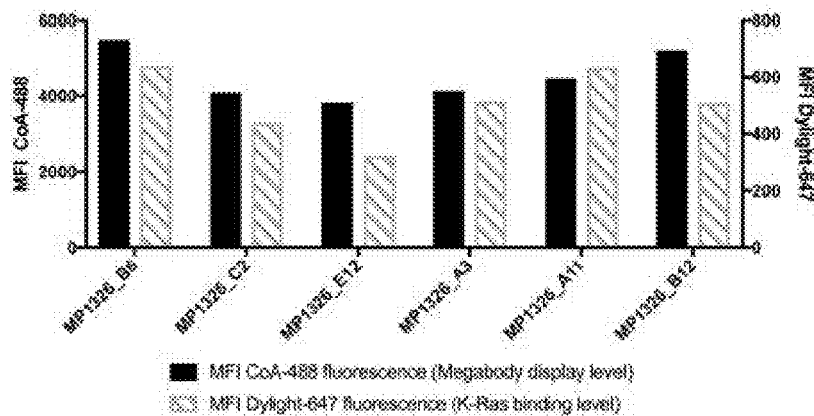

FIG. 49. Flow cytometric analysis of the functionality of $Mb_{NS1}^{cHopQ}$ variants that are displayed on the surface of EBY100 yeast cells.

The representatives of yeast-display selected $Mb_{NS1}^{cHopQ}$ variants (Table 12) were displayed on EBY100 cells as Aga2p and ACP fusions. Individual yeast clones were separately induced and orthogonally stained with CoA-488 (2 µM) using the SFP synthase (1 µM) and incubated with 100 nM Dylight-647-labeled K-RAS. (A) Dot plot representation of the relative fluorescence intensity of individual EBY100 yeast cells transformed with a pCTCON2 derivative encoding the MP1326_All Megabody variant. Mean fluorescence intensity (MFI) of relative CoA-488 fluorescence (Megabody display level) and relative Dylight-647 fluorescence (K-Ras binding) were calculated for each individual yeast clone using Prism 7 software (GraphPad). (B) Chart representation of the calculated mean fluorescence intensities (MFI) of relative CoA-488 and Dylight-647 fluorescence for each individual $Mb_{NS1}^{cHopQ}$ variant (Table 12).

Figure 50:
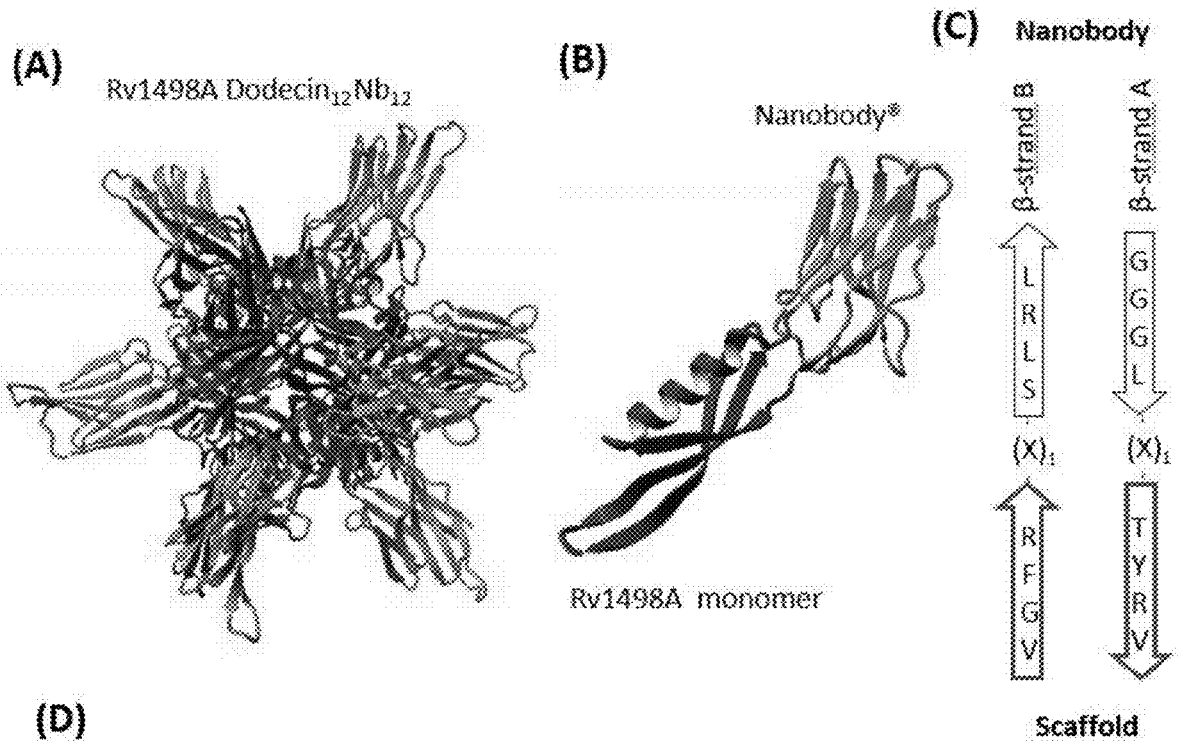

FIG. 50. Rigid display of a Nanobody on Dodecin Rv1498A from *M. tuberculosis*.

(A) Schematic representation of a Dodecin Rv1498A (inner molecules), rigidly displaying 12 copies of a Nanobody (outer molecules) in a regular and rigid array. (B) 3D Model of an antigen-binding chimeric protein made by a fusion of a GFP-specific Nanobody (top, SEQ ID NO:1) connected to Rv1498A monomer (bottom, SEQ ID NO:192) via two peptide linkers. In this particular antigen-binding chimeric protein, no circular permutation of the scaffold protein was required because the N-terminus and the C-terminus of wild type Rv1498A are close to each other and well positioned for engineering two short polypeptide linkages that connect Nanobody to Rv1498A. (C) The first β-strand of a Nanobody (β-strand A) is followed by Rv1498A, then followed by the C-terminal part of the Nanobody. (D) Amino acid sequences of the resulting antigen-binding chimeric proteins. $Nb_{GFP}207$ sequences in bold, $(X)_1$ is a short peptide linker of 1 amino acid length and mixed composition, Rv1498A sequences are underlined. The C-terminal tag includes 6×His and EPEA.

Figure 51:
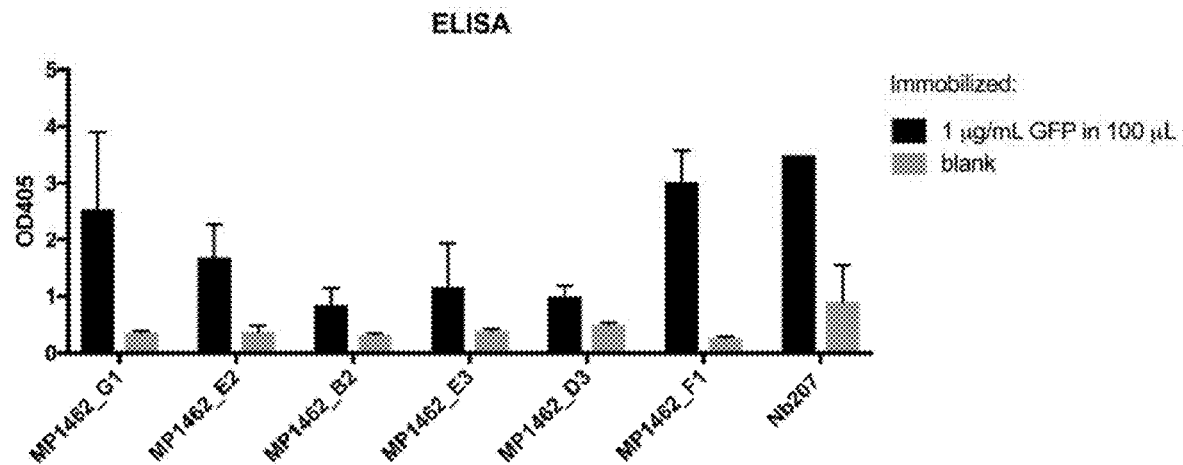

FIG. 51. GFP binding analysis of six selected $Mb_{Nb207}^{Dodecin}$ variants by ELISA.

Periplasmic extracts containing six $Mb_{Nb207}^{Dodecin}$ variants (Table 13) and $Nb_{GFP}207$ Nanobody (SEQ ID NO:1), were incubated on wells containing immobilized GFP or non-coated wells. The EPEA-tag that is present on the C-terminus of the Megabodies was detected using a biotinylated anti-EPEA (Capture select C-tag) antibody mixed with a Streptavidin-Alkaline conjugate. Absorbance at 405 nm ($OD_{405}$) was measured after incubation with 4-nitrophenyl phosphate disodium salt hexahydrate substrate (DNPP). The data is shown as mean standard error of the mean (s.e.m.) from the experiment performed in triplicates (n=3).

Figure 52:
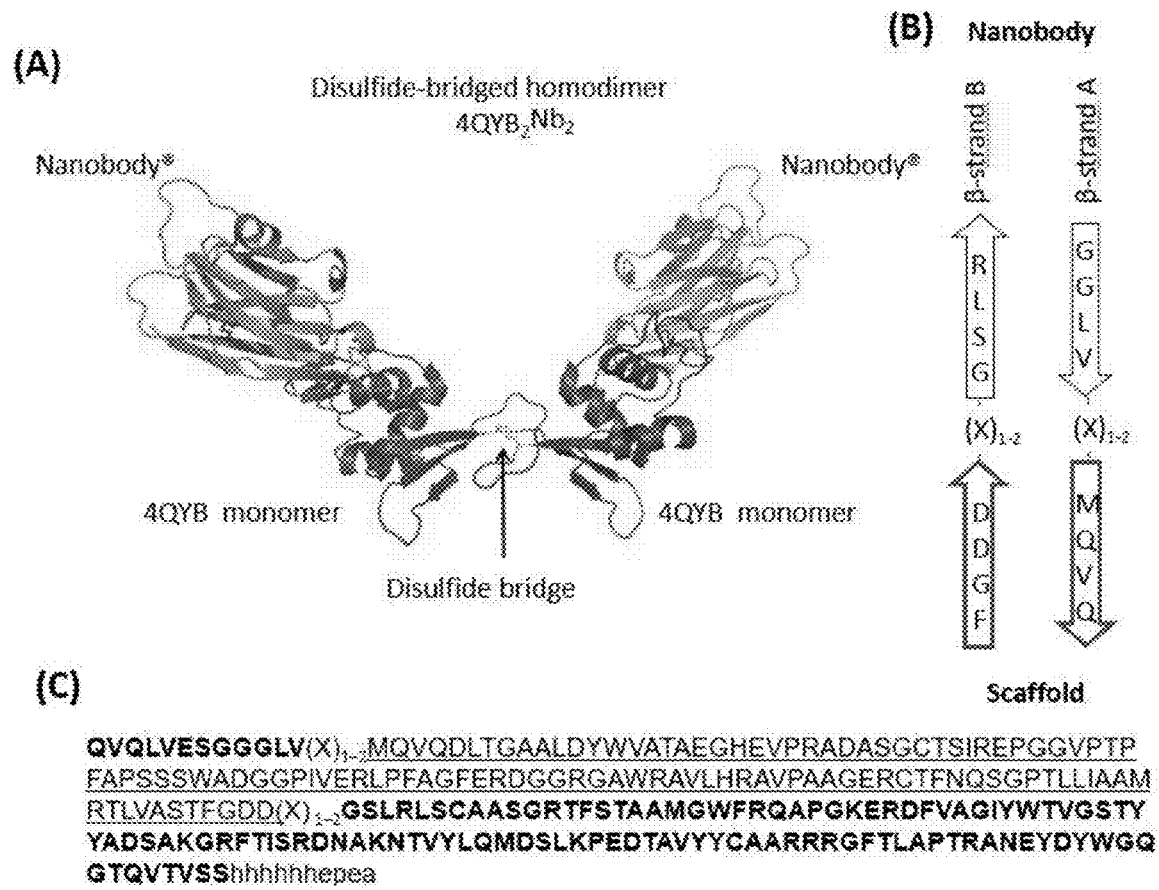

FIG. 52. Rigid display of a Nanobody on disulfide-bridged homodimer from *B. cenocepacia*.

(A) Schematic representation of a homodimer of 4QYB (inner molecules, SEQ ID NO:200), rigidly fused to GFP-specific Nanobody (outer molecules, SEQ ID NO:1) via two peptide linkers. (B) The first β-strand of a Nanobody (β-strand A) is followed by 4QYB, then followed by the C-terminal part of the Nanobody. (C) Amino acid sequences of the resulting antigen-binding chimeric proteins. $Nb_{GFP}207$ sequences in bold, $(X)_{1-2}$ is a short peptide linker of variable length (1 or 2 amino acids) and mixed composition, 4QYB sequences are underlined. The C-terminal tag includes 6×His and EPEA.

Figure 53:
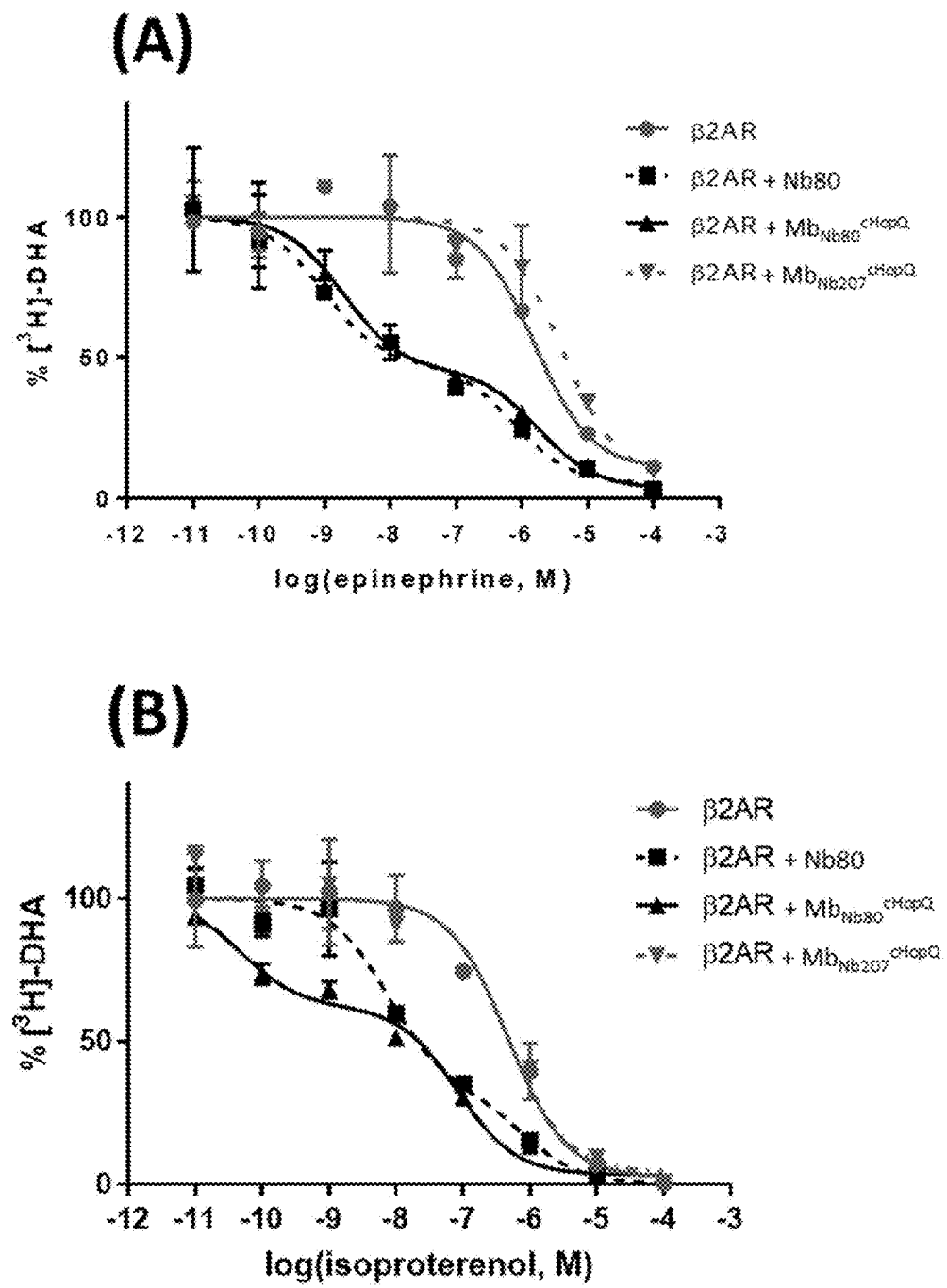

FIG. 53. Ligand binding properties of β2AR-wt in the presence or absence of $Mb_{Nb80}^{cHO-Q}$ Radioligand displacement assays of different ligands competing with [³H]-dihydroalprenolol ([³H]-DHA) for binding to β2AR-wt in the presence of $Mb_{Nb80}^{cHopQ}$ (black upward triangle) compared to β2AR-wt in the presence of Nb80 (black squares), and to β2AR-wt alone (grey circles) or in the presence of the irrelevant of $Mb_{Nb207}^{cHopQ}$ (grey triangle). Competition assays were performed on the β2AR-wt receptor using the natural agonist epinephrine (A) and the agonist (−)-isoproterenol (B) as the competing ligand, respectively. Curves have been fitted by non-linear regression to a model for competitive binding using the standard settings of Graphpad Prism.

DETAILED DESCRIPTION TO THE INVENTION

The present invention will be described with respect to particular embodiments and with reference to certain drawings but the invention is not limited thereto but only by the claims. Any reference signs in the claims shall not be construed as limiting the scope. Of course, it is to be understood that not necessarily all aspects or advantages may be achieved in accordance with any particular embodiment of the invention. Thus, for example those skilled in the art will recognize that the invention may be embodied or carried out in a manner that achieves or optimizes one advantage or group of advantages as taught herein without necessarily achieving other aspects or advantages as may be taught or suggested herein. The invention, both as to organization and method of operation, together with features and advantages thereof, may best be understood by reference to the following detailed description when read in conjunction with the accompanying drawings. The aspects and advantages of the invention will be apparent from and elucidated with reference to the embodiment(s) described hereinafter. Reference throughout this specification to "one embodiment" or "an embodiment" means that a particular feature, structure or characteristic described in connection with the embodiment is included in at least one embodiment of the present invention. Thus, appearances of the phrases "in one embodiment" or "in an embodiment" in various places throughout this specification are not necessarily all referring to the same embodiment, but may. Similarly, it should be appreciated that in the description of exemplary embodiments of the invention, various features of the invention are sometimes grouped together in a single embodiment, figure, or description thereof for the purpose of streamlining the disclosure and aiding in the understanding of one or more of the various inventive aspects. This method of disclosure, however, is not to be interpreted as reflecting an intention that the claimed invention requires more features than are expressly recited in each claim. Rather, as the following claims reflect, inventive aspects lie in less than all features of a single foregoing disclosed embodiment.

Definitions

Where an indefinite or definite article is used when referring to a singular noun e.g. "a" or "an", "the", this includes a plural of that noun unless something else is specifically stated. Where the term "comprising" is used in the present description and claims, it does not exclude other elements or steps. Furthermore, the terms first, second, third and the like in the description and in the claims, are used for distinguishing between similar elements and not necessarily for describing a sequential or chronological order. It is to be understood that the terms so used are interchangeable under appropriate circumstances and that the embodiments, of the invention described herein are capable of operation in other sequences than described or illustrated herein. The following terms or definitions are provided solely to aid in the understanding of the invention. Unless specifically defined herein, all terms used herein have the same meaning as they would to one skilled in the art of the present invention. Practitioners are particularly directed to Sambrook et al., Molecular Cloning: A Laboratory Manual, 4$^{th}$ ed., Cold Spring Harbor Press, Plainsview, New York (2012); and Ausubel et al., Current Protocols in Molecular Biology (Supplement 114), John Wiley & Sons, New York (2016), for definitions and terms of the art. The definitions provided herein should not be construed to have a scope less than understood by a person of ordinary skill in the art.

"About" as used herein when referring to a measurable value such as an amount, a temporal duration, and the like, is meant to encompass variations of ±20% or ±10%, more preferably ±5%, even more preferably ±1%, and still more preferably ±0.1% from the specified value, as such variations are appropriate to perform the disclosed methods. 'Similar' as used herein, is interchangeable for alike, analogous, comparable, corresponding, and like, and is meant to have the same or common characteristics, and/or in a quantifiable manner to show comparable results i.e. with a variation of maximum 20%, 10%, more preferably 5%, or even more preferably 1%, or less.

"Nucleotide sequence", "DNA sequence" or "nucleic acid molecule(s)" as used herein refers to a polymeric form of nucleotides of any length, either ribonucleotides or deoxyribonucleotides. This term refers only to the primary structure of the molecule. Thus, this term includes double- and single-stranded DNA, and RNA. It also includes known types of modifications, for example, methylation, "caps" substitution of one or more of the naturally occurring nucleotides with an analog. By "nucleic acid construct" it is meant a nucleic acid sequence that has been constructed to comprise one or more functional units not found together in nature. Examples include circular, linear, double-stranded, extrachromosomal DNA molecules (plasmids), cosmids (plasmids containing COS sequences from lambda phage), viral genomes comprising non-native nucleic acid sequences, and the like.

"Coding sequence" is a nucleotide sequence, which is transcribed into mRNA and/or translated into a polypeptide when placed under the control of appropriate regulatory sequences. The boundaries of the coding sequence are determined by a translation start codon at the 5'-terminus and a translation stop codon at the 3'-terminus. A coding sequence can include, but is not limited to mRNA, cDNA, recombinant nucleotide sequences or genomic DNA, while introns may be present as well under certain circumstances.

"Promoter region of a gene" as used here refers to a functional DNA sequence unit that, when operably linked to a coding sequence and possibly placed in the appropriate inducing conditions, is sufficient to promote transcription of said coding sequence. "Operably linked" refers to a juxtaposition wherein the components so described are in a relationship permitting them to function in their intended manner. A promoter sequence "operably linked" to a coding sequence is ligated in such a way that expression of the coding sequence is achieved under conditions compatible with the promoter sequence. "Gene" as used here includes both the promoter region of the gene as well as the coding sequence. It refers both to the genomic sequence (including possible introns) as well as to the cDNA derived from the spliced messenger, operably linked to a promoter sequence. The term "terminator" or "transcription termination signal" encompasses a control sequence which is a DNA sequence at the end of a transcriptional unit which signals 3' processing and polyadenylation of a primary transcript and termination of transcription. The terminator can be derived from the natural gene, from a variety of other plant genes, or from T-DNA. The terminator to be added may be derived from, for example, the nopaline synthase or octopine synthase genes, or alternatively from another plant gene, or less preferably from any other eukaryotic gene.

With a "chimeric gene" or "chimeric construct" or "chimeric gene construct" is meant a recombinant nucleic acid sequence in which a promoter or regulatory nucleic acid sequence is operatively linked to, or associated with, a nucleic acid sequence that codes for an mRNA, such that the regulatory nucleic acid sequence is able to regulate transcription or expression of the associated nucleic acid coding sequence. The regulatory nucleic acid sequence of the chimeric gene is not operatively linked to the associated nucleic acid sequence as found in nature.

An "expression cassette" comprises any nucleic acid construct capable of directing the expression of a gene/coding sequence of interest, which is operably linked to a promoter of the expression cassette. Expression cassettes are generally DNA constructs preferably including (5' to 3' in the direction of transcription): a promoter region, a polynucleotide sequence, homologue, variant or fragment thereof operably linked with the transcription initiation region, and a termination sequence including a stop signal for RNA polymerase and a polyadenylation signal. It is understood that all of these regions should be capable of operating in biological cells, such as prokaryotic or eukaryotic cells, to be transformed. The promoter region comprising the transcription initiation region, which preferably includes the RNA polymerase binding site, and the polyadenylation signal may be native to the biological cell to be transformed or may be derived from an alternative source, where the region is functional in the biological cell. Such cassettes can be constructed into a "vector".

The term "vector", "vector construct," "expression vector," or "gene transfer vector," as used herein, is intended to refer to a nucleic acid molecule capable of transporting another nucleic acid molecule to which it has been linked, and includes any vector known to the skilled person, including any suitable type. including, but not limited to, plasmid vectors, cosmid vectors, phage vectors, such as lambda phage, viral vectors, such as adenoviral, AAV or baculoviral vectors, or artificial chromosome vectors such as bacterial artificial chromosomes (BAC), yeast artificial chromosomes (YAC), or P1 artificial chromosomes (PAC). Expression vectors comprise plasmids as well as viral vectors and generally contain a desired coding sequence and appropriate DNA sequences necessary for the expression of the operably linked coding sequence in a particular host organism (e.g., bacteria, yeast, plant, insect, or mammal) or in in vitro expression systems. Expression vectors are capable of autonomous replication in a host cell into which they are introduced (e.g., vectors having an origin of replication which functions in the host cell). Other vectors can be integrated into the genome of a host cell upon introduction into the host cell, and are thereby replicated along with the host genome. Suitable vectors have regulatory sequences, such as promoters, enhancers, terminator sequences, and the like as desired and according to a particular host organism (e.g. bacterial cell, yeast cell). Cloning vectors are generally used to engineer and amplify a certain desired DNA fragment and may lack functional sequences needed for expression of the desired DNA fragments. The construction of expression vectors for use in transfecting prokaryotic cells is also well known in the art, and thus can be accomplished via standard techniques (see, for example, Sambrook, et al. Molecular Cloning: A Laboratory Manual, 4$^{th}$ ed., Cold Spring Harbor Press, Plainsview, New York (2012); and Ausubel et al., Current Protocols in Molecular Biology (Supplement 114), John Wiley & Sons, New York (2016), for definitions and terms of the art. 'Host cells' can be either prokaryotic or eukaryotic. The cells can be transiently or stably transfected. Such transfection of expression vectors into prokaryotic and eukaryotic cells can be accomplished via any technique known in the art, including but not limited to standard bacterial transformations, calcium phosphate co-precipitation, electroporation, or liposome mediated-, DEAE dextran mediated-, polycationic mediated-, or viral mediated transfection. For all standard techniques see, for example, Sambrook et al., Molecular Cloning: A Laboratory Manual, 4$^{th}$ ed., Cold Spring Harbor Press, Plainsview, New York (2012); and Ausubel et al., Current Protocols in Molecular Biology (Supplement 114), John Wiley & Sons, New York (2016). Recombinant host cells, in the present context, are those which have been genetically modified to contain an isolated DNA molecule, nucleic acid molecule or expression construct or vector of the invention. The DNA can be introduced by any means known to the art which are appropriate for the particular type of cell, including without limitation, transformation, lipofection, electroporation or viral mediated transduction. A DNA construct capable of enabling the expression of the chimeric protein of the invention can be easily prepared by the art-known techniques such as cloning, hybridization screening and Polymerase Chain Reaction (PCR). Standard techniques for cloning, DNA isolation, amplification and purification, for enzymatic reactions involving DNA ligase, DNA polymerase, restriction endonucleases and the like, and various separation techniques are those known and commonly employed by those skilled in the art. A number of standard techniques are described in Sambrook et al. (2012), Wu (ed.) (1993) and Ausubel et al. (2016). Representative host cells that may be used with the invention include, but are not limited to, bacterial cells, yeast cells, plant cells and animal cells. Bacterial host cells suitable for use with the invention include *Escherichia* spp. cells, *Bacillus* spp. cells, *Streptomyces* spp. cells, *Erwinia* spp. cells, *Klebsiella* spp. cells, *Serratia* spp. cells, *Pseudomonas* spp. cells, and *Salmonella* spp. cells. Animal host cells suitable for use with the invention include insect cells and mammalian cells (most particularly derived from Chinese hamster (e.g. CHO), and human cell lines, such as HeLa. Yeast host cells suitable for use with the invention include species within *Saccharomyces, Schizosaccharomyces, Kluyveromyces, Pichia* (e.g. *Pichia pastoris*), *Hansenula* (e.g. *Hansenula polymorpha*), Yarowia, Schwaniomyces, *Schizosaccharomyces, Zygosaccharomyces* and the like. *Saccharomyces cerevisiae, S. carlsbergensis* and *K. lactis* are the most commonly used yeast hosts, and are convenient fungal hosts. The host cells may be provided in suspension or flask cultures, tissue cultures, organ cultures and the like. Alternatively, the host cells may also be transgenic animals.

The terms "protein", "polypeptide", "peptide" are interchangeably used further herein to refer to a polymer of amino acid residues and to variants and synthetic analogues of the same. Thus, these terms apply to amino acid polymers in which one or more amino acid residues is a synthetic non-naturally occurring amino acid, such as a chemical analogue of a corresponding naturally occurring amino acid, as well as to naturally-occurring amino acid polymers. This term also includes posttranslational modifications of the polypeptide, such as glycosylation, phosphorylation and acetylation. Based on the amino acid sequence and the modifications, the atomic or molecular mass or weight of a polypeptide is expressed in (kilo)dalton (kDa). By "recombinant polypeptide" is meant a polypeptide made using recombinant techniques, i.e., through the expression of a recombinant or synthetic polynucleotide. When the chimeric polypeptide or biologically active portion thereof is recombinantly produced, it is also preferably substantially free of culture medium, i.e., culture medium represents less than about 20%, more preferably less than about 10%, and most preferably less than about 5% of the volume of the protein preparation. By "isolated" is meant material that is substantially or essentially free from components that normally accompany it in its native state. For example, an "isolated polypeptide" refers to a polypeptide which has been purified from the molecules which flank it in a naturally-occurring state, e.g., an antigen-binding chimeric protein which has been removed from the molecules present in the production host that are adjacent to said polypeptide. An isolated chimer can be generated by amino acid chemical synthesis or can be generated by recombinant production. The expression "heterologous protein" may mean that the protein is not derived from the same species or strain that is used to display or express the protein.

"Homologue", "Homologues" of a protein encompass peptides, oligopeptides, polypeptides, proteins and enzymes having amino acid substitutions, deletions and/or insertions relative to the unmodified protein in question and having similar biological and functional activity as the unmodified protein from which they are derived. The term "amino acid identity" as used herein refers to the extent that sequences are identical on an amino acid-by-amino acid basis over a window of comparison. Thus, a "percentage of sequence identity" is calculated by comparing two optimally aligned sequences over the window of comparison, determining the number of positions at which the identical amino acid residue (e.g., Ala, Pro, Ser, Thr, Gly, Val, Leu, lie, Phe, Tyr, Trp, Lys, Arg, His, Asp, Glu, Asn, Gln, Cys and Met, also indicated in one-letter code herein) occurs in both sequences to yield the number of matched positions, dividing the number of matched positions by the total number of positions in the window of comparison (i.e., the window size), and multiplying the result by 100 to yield the percentage of sequence identity. A "substitution", or "mutation" as used herein, results from the replacement of one or more amino acids or nucleotides by different amino acids or nucleotides, respectively as compared to an amino acid sequence or nucleotide sequence of a parental protein or a fragment thereof. It is understood that a protein or a fragment thereof may have conservative amino acid substitutions which have substantially no effect on the protein's activity.

The term "wild-type" refers to a gene or gene product isolated from a naturally occurring source. A wild-type gene is that which is most frequently observed in a population and is thus arbitrarily designed the "normal" or "wild-type" form of the gene. In contrast, the term "modified", "mutant" or "variant" refers to a gene or gene product that displays modifications in sequence, post-translational modifications and/or functional properties (i.e., altered characteristics) when compared to the wild-type gene or gene product. It is noted that naturally occurring mutants can be isolated; these are identified by the fact that they have altered characteristics when compared to the wild-type gene or gene product.

A "protein domain" is a distinct functional and/or structural unit in a protein. Usually a protein domain is responsible for a particular function or interaction, contributing to the overall role of a protein. Domains may exist in a variety of biological contexts, where similar domains can be found in proteins with different functions.

Protein secondary structure elements (SSEs) typically spontaneously form as an intermediate before the protein folds into its three dimensional tertiary structure. The two most common secondary structural elements of proteins are alpha helices and beta (β) sheets, though β-turns and omega loops occur as well. Beta sheets consist of beta strands (also β-strand) connected laterally by at least two or three backbone hydrogen bonds, forming a generally twisted, pleated sheet. A β-strand is a stretch of poly-peptide chain typically 3 to 10 amino acids long with backbone in an extended conformation. A β-turn is a type of non-regular secondary structure in proteins that causes a change in direction of the polypeptide chain. Beta turns (P turns, β-turns, β-bends, tight turns, reverse turns) are very common motifs in proteins and polypeptides, which mainly serve to connect β-strands. For the IMGT© definition of β-turn, as present in a variable domain, see also LeFranc (2014), and FIG. 25. β-turns typically consist of four amino acid residues (labelled i, i+1, i+2 and i+3), and are defined in two ways: or by the possession of an intra-main-chain hydrogen bond between the CO of residue i and the NH of residue i+3; or alternatively, by having a distance of less than 7 Å between the Cα atoms of residues i and i+3. The hydrogen bond criterion is the one most appropriate for everyday use, partly because it gives rise to four distinct categories.

The term "circular permutation of a protein" or "circularly permutated protein" refers to a protein which has a changed order of amino acids in its amino acid sequence, as compared to the wild type protein sequence, with as a result a protein structure with different connectivity, but overall similar three-dimensional (3D) shape. A circular permutation of a protein is analogous to the mathematical notion of a cyclic permutation, in the sense that the sequence of the first portion of the wild type protein (adjacent to the N-terminus) is related to the sequence of the second portion of the resulting circularly permutated protein (near its C-terminus), as described for instance in Bliven and Prlic (2012). A circular permutation of a protein as compared to its wild protein is obtained through genetic or artificial engineering of the protein sequence, whereby the N- and C-terminus of the wild type protein are 'connected' and the protein sequence is interrupted at another site, to create a novel N- and C-terminus of said protein. The circularly permutated scaffold proteins of the invention are the result of a connected N- and C-terminus of the wild type protein sequence, and a cleavage or interrupted sequence at an accessible or exposed site (preferentially a β-turn or loop) of said scaffold protein, whereby the folding of the circularly permutate scaffold protein is retained or similar as compared to the folding of the wild type protein. Said connection of the N- and C-terminus in said circularly permutated scaffold protein may be the result of a peptide bond linkage, or of introducing a peptide linker, or of a deletion of a peptide stretch near the original N- and C-terminus if the wild type protein, followed by a peptide bond or the remaining amino acids.

The term "fused to", as used herein, and interchangeably used herein as "connected to", "conjugated to", "ligated to" refers, in particular, to "genetic fusion", e.g., by recombinant DNA technology, as well as to "chemical and/or enzymatic conjugation" resulting in a stable covalent link.

Figure 28:
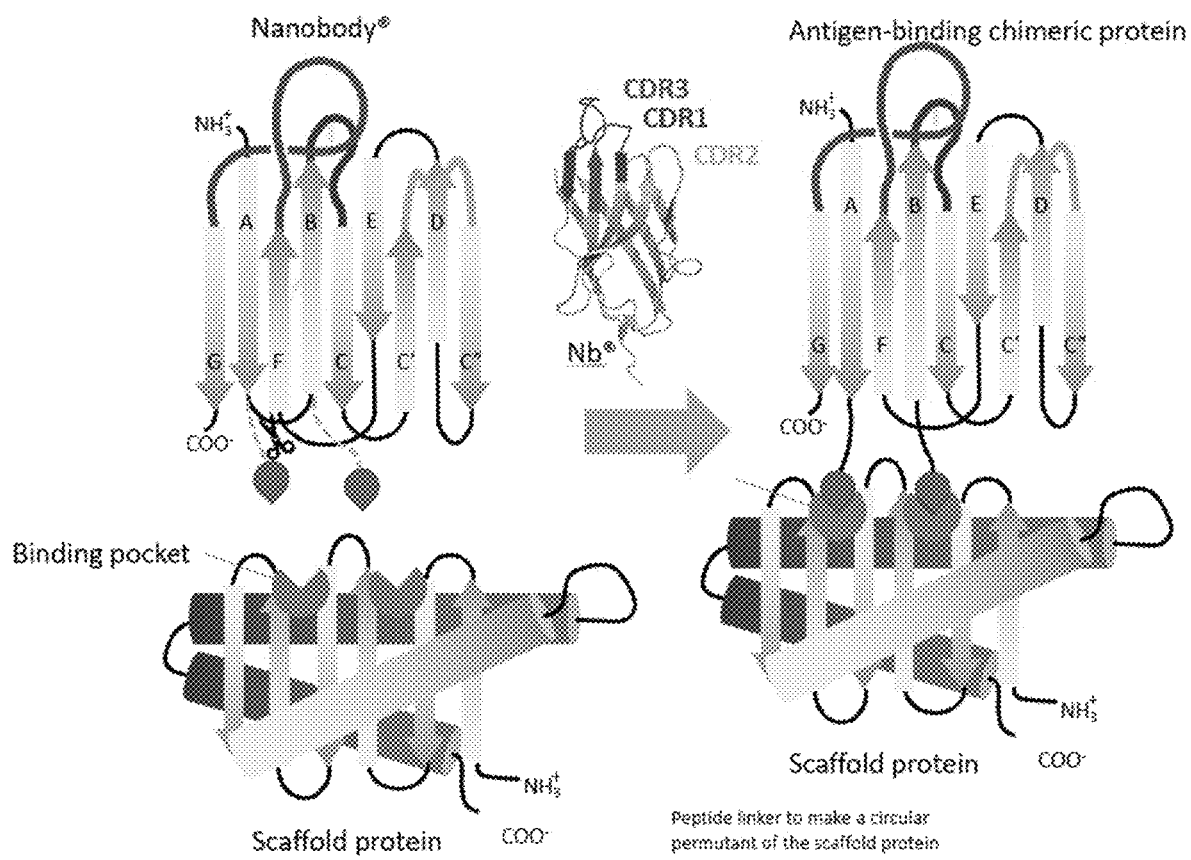
Figure 29A:
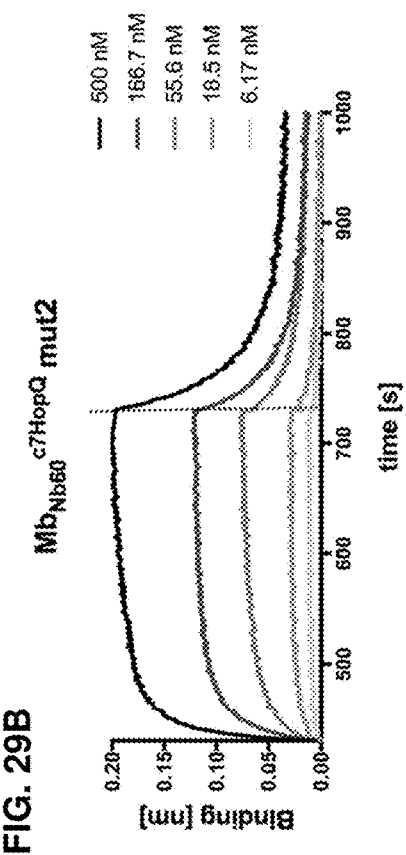
Figure 29B:
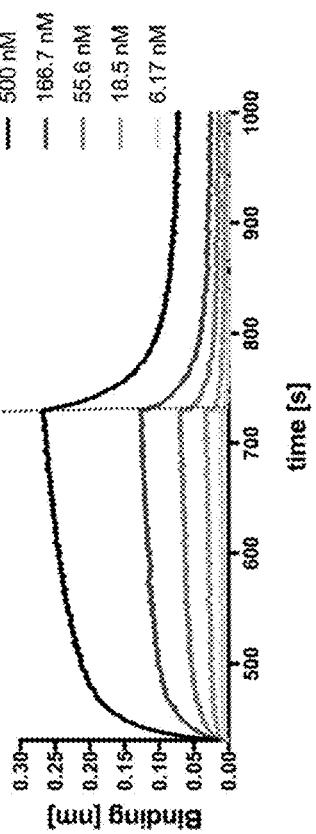
Figure 29C:
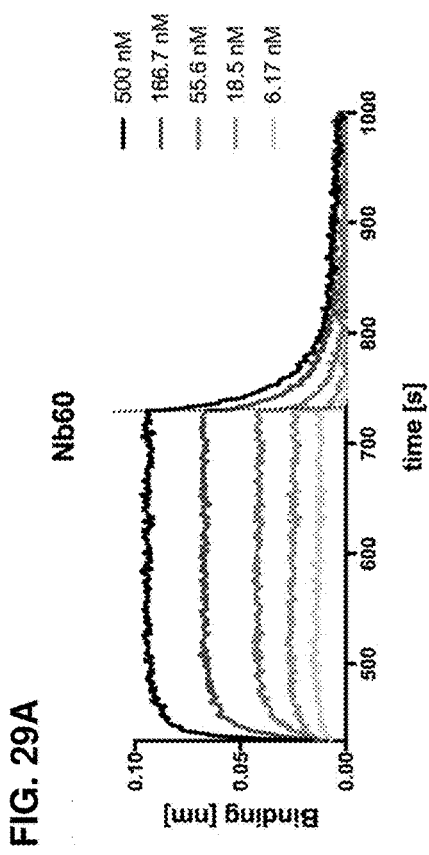
Figure 29D:
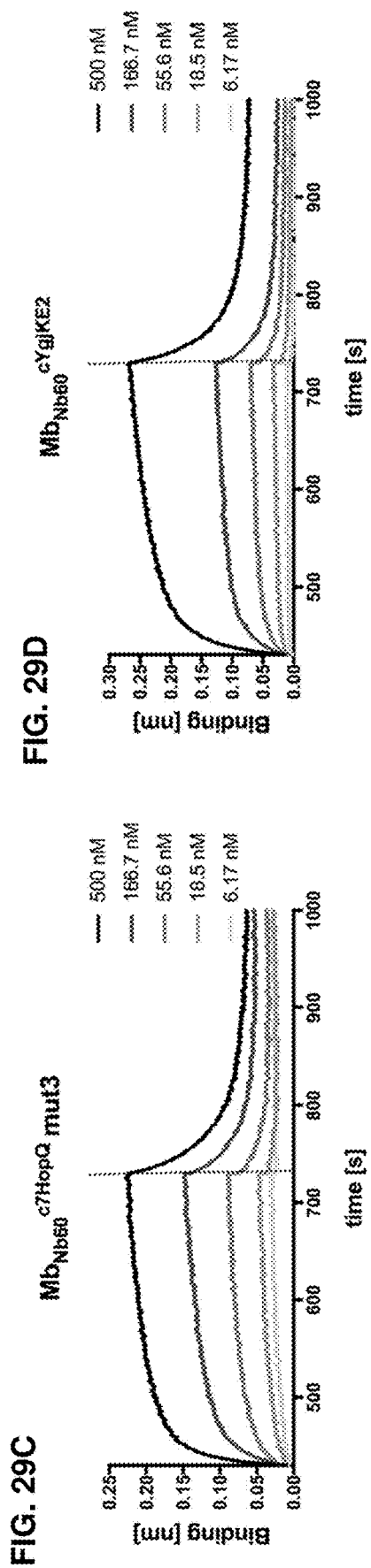

The terms "chimeric polypeptide", "chimeric protein", "chimer", "fusion polypeptide", "fusion protein", or "non-naturally-occurring protein" are used interchangeably herein and refer to a protein that comprises at least two separate and distinct polypeptide components that may or may not originate from the same protein. The term also refers to a non-naturally occurring molecule which means that it is man-made. The term "fused to", and other grammatical equivalents, such as "covalently linked", "connected", "attached", "ligated", "conjugated" when referring to a chimeric polypeptide (as defined herein) refers to any chemical or recombinant mechanism for linking two or more polypeptide components. The fusion of the two or more polypeptide components may be a direct fusion of the sequences or it may be an indirect fusion, e.g. with intervening amino acid sequences or linker sequences, or chemical linkers. The fusion of two polypeptides or of an antigen-binding domain and a scaffold protein, as described herein, may also refer to a non-covalent fusion obtained by chemical linking. For instance, the C-terminus of the A-strand and the N-terminus of the B-strand of the antigen-binding domain could both be linked to a chemical unit, which is capable of binding a complementary chemical unit or binding pocket linked or fused to parts or full length (circularly permutated) scaffold protein, at its exposed or accessible sites (as shown in FIG. 28).

As used herein, the term "protein complex" or "complex" or "assembled protein(s)" refers to a group of two or more associated macromolecules, whereby at least one of the macromolecules is a protein. A protein complex, as used herein, typically refers to associations of macromolecules that can be formed under physiological conditions. Individual members of a protein complex are linked by non-covalent interactions. A protein complex can be a non-covalent interaction of only proteins, and is then referred to as a protein-protein complex; for instance, a non-covalent interaction of two proteins, of three proteins, of four proteins, etc. More specifically, a complex of the antigen-binding chimeric protein and the antigen itself. As used herein, a protein complex can also be a non-covalent interaction of at least one protein and at least other macromolecule, such as a nucleic acid, and is then referred to as a protein-nucleic acid complex; for instance, a non-covalent interaction of one protein and one nucleic acid, two proteins and one nucleic acid, two proteins and two nucleic acids, etc. It will be understood that a protein complex can be multimeric. Protein complex assembly can result in the formation of homo-multimeric or hetero-multimeric complexes. Moreover, interactions can be stable or transient. The term "multimer(s)", "multimeric complex", or "multimeric protein(s)" comprises a plurality of identical or heterologous polypeptide monomers. Polypeptides can be capable of self-assembling into multimeric assemblies (i.e.: dimers, trimers, hexamers, pentamers, octamers, etc.) formed from self-assembly of a plurality of a single polypeptide monomers (i.e., "homo-multimeric assemblies"). As used herein, a "plurality" means 2 or more. The multimeric assembly comprises 3, 4, 5, 6, 7, 8, 9, 10, 11, 12, or more polypeptide monomers. The multimeric assemblies can be used for any purpose, and provide a way to develop a wide array of protein "nanomaterials." In addition to the finite, cage-like or shell-like protein assemblies, they may be designed by choosing an appropriate target symmetric architecture. The monomers and/or multimeric assemblies of the invention can be used in the design of higher order assemblies with the attendant advantages of hierarchical assembly. The resulting multimeric assemblies are highly ordered materials with superior rigidity and monodispersity, and can form the basis of advanced functional materials and custom-designed molecular machines with wide-ranging applications.

As used herein, the terms "determining," "measuring," "assessing," and "assaying" are used interchangeably and include both quantitative and qualitative determinations.

The terms "suitable conditions" refers to the environmental factors, such as temperature, movement, other components, and/or "buffer condition(s)" among others, wherein "buffer conditions" refers specifically to the composition of the solution in which the assay is performed. The said composition includes buffered solutions and/or solutes such as pH buffering substances, water, saline, physiological salt solutions, glycerol, preservatives, etc. for which a person skilled in the art is aware of the suitability to obtain optimal assay performance.

"Binding" means any interaction, be it direct or indirect. A direct interaction implies a contact between the binding partners. An indirect interaction means any interaction whereby the interaction partners interact in a complex of more than two molecules. The interaction can be completely indirect, with the help of one or more bridging molecules, or partly indirect, where there is still a direct contact between the partners, which is stabilized by the additional interaction of one or more molecules. In general, a binding domain can be immunoglobulin-based or immunoglobulin-like or it can be based on domains present in proteins, including but not limited to microbial proteins, protease inhibitors, toxins, fibronectin, lipocalins, single chain antiparallel coiled coil proteins or repeat motif proteins. By the term "specifically binds," as used herein with respect to an antigen-binding, immunoglobulin, immunoglobulin-like domain or antibody domain, is meant a binding domain which recognizes a specific antigen, but does not substantially recognize or bind other molecules in a sample, and is also referred to as an "antigen-binding domain" or "antigen-binding protein". For example, an antibody that specifically binds to an antigen from one species may also bind to that antigen from one or more species. But, such cross-species reactivity does not itself alter the classification of an antibody as specific. In some instances, the terms "specific binding" or "specifically binding," can be used in reference to the interaction of an antibody, a protein, or a peptide with a second chemical species, to mean that the interaction is dependent upon the presence of a particular structure (e.g. an antigenic determinant or epitope) on the chemical species; for example, an antigen-binding protein recognizes and binds to a specific protein structure rather than to proteins generally. If an antigen-binding protein is specific for epitope "A", the presence of a molecule containing epitope A (or free, unlabeled A), in a reaction containing labeled "A" and the antigen-binding protein, will reduce the amount of labeled A bound to the antigen-binding protein. The term "specificity", as used herein, refers to the ability of a binding domain, in particular an antigen-binding domain, immunoglobulin, or immunoglobulin-like domain, or an immunoglobulin fragment, such as a VHH or Nanobody, to bind preferentially to one antigen, versus a different antigen, and does not necessarily imply high affinity. Further examples of antigen-binding proteins also include synthetic binding proteins, antibody mimetics, or more specifically also monobodies (e.g. for a review see Sha et al., 2017). Such monobodies are defined as Fibronectin type III domain comprising binding proteins, which bind specifically to target proteins in a similar manner as camelid single domain antibodies (VHHs), because of their similar global fold as compare to an immunoglobulin fold. The monobodies concern the most widely used non-antibody scaffold, which due to its fibronectin type III domain represents an immunoglobulin-like fold, involving 7 anti-parallel β-strands, such as the variable domains of antibodies, connected on one side of the domain by FN3 loops, or βturns, representing the antigen-binding region, similar to CDRs of antibodies, and on the other side by βturns which may serve as an accessible site for fusing a scaffold protein, to form the antigen-binding chimeric protein of the invention. An "epitope", as used herein, refers to an antigenic determinant of a polypeptide. An epitope could comprise 3 amino acids in a spatial conformation, which is unique to the epitope. Generally, an epitope consists of at least 4, 5, 6, 7 such amino acids, and more usually, consists of at least 8, 9, 10 such amino acids. Methods of determining the spatial conformation of amino acids are known in the art, and include, for example, X-ray crystallography and multi-dimensional nuclear magnetic resonance. A "conformational epitope", as used herein, refers to an epitope comprising amino acids in a spacial conformation that is unique to a folded 3-dimensional conformation of a polypeptide. Generally, a conformational epitope consists of amino acids that are discontinuous in the linear sequence but that come together in the folded structure of the protein. However, a conformational epitope may also consist of a linear sequence of amino acids that adopts a conformation that is unique to a folded 3-dimensional conformation of the polypeptide (and not present in a denatured state). In protein complexes, conformational epitopes consist of amino acids that are discontinuous in the linear sequences of one or more polypeptides that come together upon folding of the different folded polypeptides and their association in a unique quaternary structure. Similarly, conformational epitopes may here also consist of a linear sequence of amino acids of one or more polypeptides that come together and adopt a conformation that is unique to the quaternary structure. The term "conformation" or "conformational state" of a protein refers generally to the range of structures that a protein may adopt at any instant in time. One of skill in the art will recognize that determinants of conformation or conformational state include a protein's primary structure as reflected in a protein's amino acid sequence (including modified amino acids) and the environment surrounding the protein. The conformation or conformational state of a protein also relates to structural features such as protein secondary structures (e.g., α-helix, β-sheet, among others), tertiary structure (e.g., the three dimensional folding of a polypeptide chain), and quaternary structure (e.g., interactions of a polypeptide chain with other protein subunits). Posttranslational and other modifications to a polypeptide chain such as ligand binding, phosphorylation, sulfation, glycosylation, or attachments of hydrophobic groups, among others, can influence the conformation of a protein. Furthermore, environmental factors, such as pH, salt concentration, ionic strength, and osmolality of the surrounding solution, and interaction with other proteins and co-factors, among others, can affect protein conformation.

The conformational state of a protein may be determined by either functional assay for activity or binding to another molecule or by means of physical methods such as X-ray crystallography, NMR, or spin labeling, among other methods. For a general discussion of protein conformation and conformational states, one is referred to Cantor and Schimmel, Biophysical Chemistry, Part I: The Conformation of Biological. Macromolecules, W. H. Freeman and Company, 1980, and Creighton, Proteins: Structures and Molecular Properties, W. H. Freeman and Company, 1993.

The term "affinity", as used herein, generally refers to the degree to which a ligand (as defined further herein) binds to a target protein so as to shift the equilibrium of target protein and ligand toward the presence of a complex formed by their binding. Thus, for example, where a antigen-binding chimeric polypeptide and a ligand are combined in relatively equal concentration, a ligand of high affinity will bind to the antigen-binding chimeric polypeptide so as to shift the equilibrium toward high concentration of the resulting complex. The dissociation constant Kd is commonly used to describe the affinity between a ligand and a target protein. Typically, the dissociation constant has a value that is lower than $10^{-5}$ M. Preferably, the dissociation constant is lower than $10^{-6}$ M, more preferably, lower than $10^{-7}$ M. Most preferably, the dissociation constant is lower than $10^{-8}$ M. Other ways of describing the affinity between a ligand and its target protein are the association constant (Ka), the inhibition constant (Ki), or indirectly by evaluating the potency of ligands by measuring the half maximal inhibitory concentration ($IC_{50}$) or half maximal effective concentration ($EC_{50}$). It will be appreciated that within the scope of the present invention, the term "affinity" is used in the context of the antigen-binding chimeric protein comprising the Ig domain that binds a (conformational) epitope of the target protein, more particularly the antigen-binding chimeric protein Ig domain retaining its "functionality" to bind its target via the CDR regions of said Ig domain.

Accordingly, as used herein, the term "functional antigen-binding protein" or "conformation-selective antigen-binding domain" in the context of the present invention refers to an Ig domain of said chimeric antigen-binding protein that is functional in binding to its target protein, optionally in a conformation-selective manner. A binding domain that selectively binds to a particular conformation of a target protein refers to a binding domain that binds with a higher affinity to a target in a subset of conformations than to other conformations that the target may assume. One of skill in the art will recognize that binding domains that selectively bind to a particular conformation of a target will stabilize or retain the target in this particular conformation. For example, an active state conformation-selective binding domain will preferentially bind to a target in an active conformational state and will not or to a lesser degree bind to a target in an inactive conformational state, and will thus have a higher affinity for said active conformational state; or vice versa.

The terms "specifically bind", "selectively bind", "preferentially bind", and grammatical equivalents thereof, are used interchangeably herein. The terms "conformational specific" or "conformational selective" are also used interchangeably herein.

The term "antibody" as used herein, refers to an immunoglobulin (Ig) molecule or a molecule comprising an immunoglobulin (Ig) domain, which specifically binds with an antigen. Antibodies can be intact immunoglobulins derived from natural sources or from recombinant sources and can be immunoreactive portions of intact immunoglobulins. Antibodies are typically tetramers of immunoglobulin molecules. The term "immunoglobulin (Ig) domain" as used herein refers to a globular region of an antibody chain, or to a polypeptide that essentially consists of such a globular region. Immunoglobulin domains are characterized in that they retain the immunoglobulin fold (Ig fold as named herein) characteristic of antibody molecules, which consists of a two-layer sandwich of about seven to nine antiparallel β-strands arranged in two β-sheets, optionally stabilized by a conserved disulphide bond. The term "immunoglobulin (Ig) domain", includes "immunoglobulin constant domain", and "immunoglobulin variable domain" (abbreviated as "IVD"), wherein the latter means an immunoglobulin domain essentially consisting of four "framework regions" which are referred to in the art and herein below as "framework region 1" or "FR1"; as "framework region 2" or "FR2"; as "framework region 3" or "FR3"; and as "framework region 4" or "FR4", respectively; which framework regions are interrupted by three "complementarity determining regions" or "CDRs", which are referred to in the art and herein below as "complementarity determining region 1" or "CDR1"; as "complementarity determining region 2" or "CDR2"; and as "complementarity determining region 3" or "CDR3", respectively. Thus, the general structure or sequence of an immunoglobulin variable domain can be indicated as follows: FR1-CDR1-FR2-CDR2-FR3-CDR3-FR4. It is the immunoglobulin variable domain(s) (IVDs) that confer specificity to an antibody for the antigen by carrying the antigen-binding site. According to IMGT classification, an immunoglobulin variable domain or V-domain comprises about 100 AA and is made of nine anti-parallel beta-strands (A,B,C,C', C'', D, E, F, and G) linked by β-turns (AB,CC', C''D, DE, and EF), and three loops (or CDRs) (BC, C'C'', and FG), forming a sandwich of two sheets [ABED] [GFCC'C''] (FIG. 25, adapted from Lefranc, 2014). The sheets are closely packed against each other through hydrophobic interactions giving a hydrophobic core, and joined together by a disulfide bridge between a first highly conserved cysteine (1st-Cys) in β-strand B (in the first sheet) and a second equally conserved cysteine (2nd-Cys) in β-strand F (in the second sheet). The unique numbering of the IMGT® definitive system, as used in the present invention, provides CDR-IMGT accurately and unambiguously delimitated in contrast to the CDR described in the literature. For alternative numbering, also see e.g. Kabat (Kabat et al., 1991) or Chothia (Chothia and Lesk, 1987). For a V-domain, the CDR1-IMGT encompasses positions 27-38, the CDR2-IMGT positions 56-65, and the CDR3-IMGT positions 105-117 (Lefranc, 2014). An "exposed region" or "exposed loop" of the Ig domain of the invention, refers to a region or polypeptide chain that is exposed at the surface of the protein. For the Ig domain, said exposed region or loop is preferably α1-turn, and most preferably a β-turn as defined by Lefranc (2014). Although the CDRs are also considered "loops" according to the IMGT definition, those are not considered as preferred candidates for "exposed regions" of the invention, with accessible sites for fusion of the scaffold, since this would most likely lead to the destruction of antigen-binding, and therefore not allow to obtain functional antigen-binding chimeric proteins.

An "immunoglobulin domain" of this invention also includes "immunoglobulin single variable domains" (abbreviated as "ISVD"), equivalent to the term "single variable domains", and defines molecules wherein the antigen binding site is present on, and formed by, a single immunoglobulin domain. This sets immunoglobulin single variable domains apart from "conventional" immunoglobulins or their fragments, wherein two immunoglobulin domains, in particular two variable domains, interact to form an antigen binding site. Typically, in conventional immunoglobulins, a heavy chain variable domain (VH) and a light chain variable domain (VL) interact to form an antigen binding site. In this case, the complementarity determining regions (CDRs) of both VH and VL will contribute to the antigen binding site, i.e. a total of 6 CDRs will be involved in antigen binding site formation. In view of the above definition, the antigen-binding domain of a conventional 4-chain antibody (such as an IgG, IgM, IgA, IgD or IgE molecule; known in the art) or of a Fab fragment, a F(ab')2 fragment, an Fv fragment such as a disulphide linked Fv or a scFv fragment, or a diabody (all known in the art) derived from such conventional 4-chain antibody, would normally not be regarded as an immunoglobulin single variable domain, as, in these cases, binding to the respective epitope of an antigen would normally not occur by one (single) immunoglobulin domain but by a pair of (associated) immunoglobulin domains such as light and heavy chain variable domains, i.e., by a VH-VL pair of immunoglobulin domains, which jointly bind to an epitope of the respective antigen. In contrast, immunoglobulin single variable domains are capable of specifically binding to an epitope of the antigen without pairing with an additional immunoglobulin variable domain. The binding site of an immunoglobulin single variable domain is formed by a single VH/VHH or VL domain. Hence, the antigen binding site of an immunoglobulin single variable domain is formed by no more than three CDRs. As such, the single variable domain may be a light chain variable domain sequence (e.g., a VL-sequence) or a suitable fragment thereof; or a heavy chain variable domain sequence (e.g., a VH-sequence or VHH sequence) or a suitable fragment thereof; as long as it is capable of forming a single antigen binding unit (i.e., a functional antigen binding unit that essentially consists of the single variable domain, such that the single antigen binding domain does not need to interact with another variable domain to form a functional antigen binding unit). In one embodiment of the invention, the immunoglobulin single variable domains are heavy chain variable domain sequences (e.g., a VH-sequence); more specifically, the immunoglobulin single variable domains can be heavy chain variable domain sequences that are derived from a conventional four-chain antibody or heavy chain variable domain sequences that are derived from a heavy chain antibody. For example, the immunoglobulin single variable domain may be a (single) domain antibody (or an amino acid sequence that is suitable for use as a (single) domain antibody), a "dAb" or dAb (or an amino acid sequence that is suitable for use as a dAb) or a Nanobody (as defined herein, and including but not limited to a VHH); other single variable domains, or any suitable fragment of any one thereof. In particular, the immunoglobulin single variable domain may be a Nanobody (as defined herein) or a suitable fragment thereof. Note: Nanobody®, Nanobodies® and Nanoclone® are registered trademarks of Ablynx N.V. For a general description of Nanobodies, reference is made to the further description below, as well as to the prior art cited herein, such as e.g. described in WO2008/020079.

Immunoglobulin domains herein also include "VHH domains", also known as VHHs, VHH domains, VHH antibody fragments, and VHH antibodies, have originally been described as the antigen-binding immunoglobulin (Ig) (variable) domain of "heavy chain antibodies" (i.e., of "antibodies devoid of light chains"; Hamers-Casterman et al (1993) Nature 363 : 446-448). The term "VHH domain" has been chosen to distinguish these variable domains from the heavy chain variable domains that are present in conventional 4-chain antibodies (which are referred to herein as "VH domains") and from the light chain variable domains that are present in conventional 4-chain antibodies (which are referred to herein as "VL domains"). For a further description of VHHs and Nanobody, reference is made to the review article by Muyldermans (Reviews in Molecular Biotechnology 74 : 277-302 , 2001), as well as to the following patent applications, which are mentioned as general background art: WO 94/04678, WO 95/04079 and WO 96/34103 of the Vrije Universiteit Brussel; WO 94/25591, WO 99/37681, WO 00/40968, WO 00/43507, WO 00/65057, WO 01/40310, WO 01/44301, EP 1134231 and WO 02/48193 of Unilever; WO 97/49805, WO 01/21817, WO 03/035694, WO 03/054016 and WO 03/055527 of the Vlaams Instituut voor Biotechnologie (VIB); WO 03/050531 of Algonomics N.V. and Ablynx N.V.; WO 01/90190 by the National Research Council of Canada; WO 03/025020 (=EP 1433793) by the Institute of Antibodies; as well as WO 04/041867, WO 04/041862, WO 04/041865, WO 04/041863, WO 04/062551, WO 05/044858, WO 06/40153, WO 06/079372, WO 06/122786, WO 06/122787 and WO 06/122825, by Ablynx N.V. and the further published patent applications by Ablynx N.V. As described in these references, Nanobody (in particular VHH sequences and partially humanized Nanobody) can in particular be characterized by the presence of one or more "Hallmark residues" in one or more of the framework sequences. A further description of the Nanobody, including humanization and/or camelization of Nanobody, as well as other modifications, parts or fragments, derivatives or "Nanobody fusions", multivalent constructs (including some non-limiting examples of linker sequences) and different modifications to increase the half-life of the Nanobody and their preparations can be found e.g. in WO 08/101985 and WO 08/142164.

"Domain antibodies", also known as "Dabs", "Domain Antibodies", and "dAbs" (the terms "Domain Antibodies" and "dAbs" being used as trademarks by the GlaxoSmithKline group of companies) have been described in e.g., EP 0368684, Ward et al. (Nature 341: 544-546, 1989), Holt et al. (Tends in Biotechnology 21: 484-490, 2003) and WO 03/002609 as well as for example WO 04/068820, WO 06/030220, WO 06/003388 and other published patent applications of Domantis Ltd. Domain antibodies essentially correspond to the VH or VL domains of non-camelid mammalians, in particular human 4-chain antibodies. In order to bind an epitope as a single antigen binding domain, i.e., without being paired with a VL or VH domain, respectively, specific selection for such antigen binding properties is required, e.g. by using libraries of human single VH or VL domain sequences. Domain antibodies have, like VHHs, a molecular weight of approximately 13 to approximately 16 kDa and, if derived from fully human sequences, do not require humanization for e.g. therapeutical use in humans. It should also be noted that single variable domains can be derived from certain species of shark (for example, the so-called "IgNAR domains", see for example WO 05/18629).

Immunoglobulin single variable domains such as Domain antibodies and Nanobody (including VHH domains and humanized VHH domains), represent in vivo matured macromolecules upon their production, but can be further subjected to affinity maturation by introducing one or more alterations in the amino acid sequence of one or more CDRs, which alterations result in an improved affinity of the resulting immunoglobulin single variable domain for its respective antigen, as compared to the respective parent molecule. Affinity-matured immunoglobulin single variable domain molecules of the invention may be prepared by methods known in the art, for example, as described by Marks et al. (Biotechnology 10:779-783, 1992), Barbas, et al. (Proc. Nat. Acad. Sci, USA 91: 3809-3813, 1994), Shier et al. (Gene 169: 147-155, 1995), Yelton et al. (Immunol. 155:1994-2004, 1995), Jackson et al. (J. Immunol. 154: 3310-9, 1995), Hawkins et al. (J. Mol. Biol. 226: 889 896, 1992), Johnson and Hawkins (Affinity maturation of antibodies using phage display, Oxford University Press, 1996). The process of designing/selecting and/or preparing a polypeptide, starting from an immunoglobulin single variable domain such as a Domain antibody or a Nanobody, is also referred to herein as "formatting" said immunoglobulin single variable domain; and an immunoglobulin single variable domain that is made part of a polypeptide is said to be "formatted" or to be "in the format of" said polypeptide. Examples of ways in which an immunoglobulin single variable domain can be formatted and examples of such formats for instance to avoid glycosylation will be clear to the skilled person based on the disclosure herein.

Immunoglobulin single variable domains such as Domain antibodies and Nanobody (including VHH domains) can be subjected to humanization, i.e. increase the degree of sequence identity with the closest human germline sequence. In particular, humanized immunoglobulin single variable domains, such as Nanobody (including VHH domains) may be immunoglobulin single variable domains that are as generally defined for in the previous paragraphs, but in which at least one amino acid residue is present (and in particular, at least one framework residue) that is and/or that corresponds to a humanizing substitution (as defined herein). Potentially useful humanizing substitutions can be ascertained by comparing the sequence of the framework regions of a naturally occurring VHH sequence with the corresponding framework sequence of one or more closely related human VH sequences, after which one or more of the potentially useful humanizing substitutions (or combinations thereof) thus determined can be introduced into said VHH sequence (in any manner known per se, as further described herein) and the resulting humanized VHH sequences can be tested for affinity for the target, for stability, for ease and level of expression, and/or for other desired properties. In this way, by means of a limited degree of trial and error, other suitable humanizing substitutions (or suitable combinations thereof) can be determined by the skilled person. Also, based on what is described before, (the framework regions of) an immunoglobulin single variable domain, such as a Nanobody (including VHH domains) may be partially humanized or fully humanized. It should be noted that the immunoglobulin single variable domains, as well as the antigen-binding chimeric protein of the invention in their broadest sense are not limited to a specific biological source or to a specific method of preparation. For example, the immunoglobulin single variable domains, in particular the antigen-binding chimeric proteins of the invention, can generally be obtained: (1) by isolating the VHH domain of a naturally occurring heavy chain antibody, and further engineering of the sequence to obtain the antigen-binding chimeric protein; (2) by expression of a nucleotide sequence encoding a naturally occurring VHH domain, in a format fused to said scaffold protein of the antigen-binding chimeric protein; (3) by "humanization" of a naturally occurring VHH domain and/or scaffold protein or by expression of a nucleic acid encoding a such humanized VHH domain and/or scaffold protein, and/or antigen-binding chimeric protein; (4) by "mutation" of a naturally occurring VHH domain to reduce binding to pre-existing antibodies or by maticulate engineering of the scaffold protein fusion sites to obtain an antigen-binding chimeric protein of the invention with reduced binding to pre-existing antibodies as compared to the natural VHH; (5) by "camelization" of a naturally occurring VH domain from any animal species, and in particular from a mammalian species, such as from a human being, for followed fusion to said scaffold protein; or (6) by using synthetic or semisynthetic techniques for preparing proteins, polypeptides or other amino acid sequences known per se. Suitable mutations, in particular substitutions, can be introduced during humanization to generate a polypeptide with reduced binding to pre-existing antibodies (reference is made for example to WO 2012/175741 and WO2015/173325), for example at least one of the positions: 11, 13, 14, 15, 40, 41, 42, 82, 82a, 82b, 83, 84, 85, 87, 88, 89, 103, or 108. Alternatively, the positions sensitive for pre-existing antibody binding may be sterically shielded by designing the fusion to the scaffold protein as such to interfere on binding with the antigen-binding chimeric protein.

Alternative to Immunoglobulin domains, also an Ig superfamily or "Ig-like domains" are found in many proteins, which in fact constitute domains that are in sequence and structure very alike the Immunoglobulin-domain and Ig fold, respectively, but they are called Ig-like domains as to distinguish them from domains of Immunoglobulin antibodies themselves. Rather than being something special for antigen recognition it turned out that the Ig fold was particularly good for mediating interactions and was widely used. Immunoglobulin-like domains can be classified V, C1, C2, and I according to sequence pattern. Monobodies for instance comprise an immunoglobulin-like domain.

The term "detectable label", "labelling", or "tag", as used herein, refers to detectable labels or tags allowing the detection, visualization, and/or isolation, purification and/or immobilization of the isolated or purified (poly-)peptides described herein, and is meant to include any labels/tags known in the art for these purposes. Particularly preferred are affinity tags, such as chitin binding protein (CBP), maltose binding protein (MBP), glutathione-S-transferase (GST), poly(His) (e.g., 6× His or His6), Strep-tag®, Strep-tag II® and Twin-Strep-tag®; solubilization tags, such as thioredoxin (TRX), poly(NANP) and SUMO; chromatography tags, such as a FLAG-tag; epitope tags, such as V5-tag, myc-tag and HA-tag; fluorescent labels or tags (i.e., fluorochromes/-phores), such as fluorescent proteins (e.g., GFP, YFP, RFP etc.) and fluorescent dyes (e.g., FITC, TRITC, coumarin and cyanine); luminescent labels or tags, such as luciferase; and (other) enzymatic labels (e.g., peroxidase, alkaline phosphatase, beta-galactosidase, urease or glucose oxidase). Also included are combinations of any of the foregoing labels or tags. The antigen-binding chimeric protein may, for example, be fused or conjugated to a half-life extension module, or may function as a half-life extension module itself. Such modules are known to a person skilled in the art and include, for example, albumin, an albumin-binding domain, an Fc region/domain of an immunoglobulins, an immunoglobulin-binding domain, an FcRn-binding motif, and a polymer. Particularly preferred polymers include polyethylene glycol (PEG), hydroxyethyl starch (HES), hyaluronic acid, polysialic acid and PEG-mimetic peptide sequences. Modifications preventing aggregation of the isolated (poly-)peptides are also known to the skilled person and include, for example, the substitution of one or more hydrophobic amino acids, preferably surface-exposed hydrophobic amino acids, with one or more hydrophilic amino acids. In one embodiment, the isolated (poly-)peptide or the immunogenic variant thereof or the immunogenic fragment of any of the foregoing, comprises the substitution of up to 10, 9, 8, 7, 6, 5, 4, 3 or 2, preferably 5, 4, 3 or 2, hydrophobic amino acids, preferably surface-exposed hydrophobic amino acids, with hydrophilic amino acids. Preferably, other properties of the isolated (poly-)peptide, e.g., its immunogenicity, antigen-binding functionality, are not compromised by such substitution.

A "patient" or "subject", for the purpose of this invention, relates to any organism such as a vertebrate, particularly any mammal, including both a human and another mammal, e.g., an animal such as a rodent, a rabbit, a cow, a sheep, a horse, a dog, a cat, a *lama*, a pig, or a non-human primate (e.g., a monkey). The rodent may be a mouse, rat, hamster, guinea pig, or chinchilla. In one embodiment, the subject is a human, a rat or a non-human primate. Preferably, the subject is a human. In one embodiment, a subject is a subject with or suspected of having a disease or disorder, also designated "patient" herein.

The term "preventing", as used herein, may refer to stopping/inhibiting the onset of a disease or disorder (e.g., by prophylactic treatment). It may also refer to a delay of the onset, reduced frequency of symptoms, or reduced severity of symptoms associated with the disease or disorder (e.g., by prophylactic treatment). The term "treatment" or "treating" or "treat" can be used interchangeably and are defined by a therapeutic intervention that slows, interrupts, arrests, controls, stops, reduces, or reverts the progression or severity of a sign, symptom, disorder, condition, or disease, but does not necessarily involve a total elimination of all disease-related signs, symptoms, conditions, or disorders.

DETAILED DESCRIPTION

A novel concept for the design of rigidly fused antigen-binding domain-containing chimeric proteins is presented herein. The novel antigen-binding chimera originate through generation of fusions between an antigen-binding domain and a scaffold protein, wherein the scaffold protein interrupts the topology of the antigen-binding protein, which surprisingly still appears in its typical fold and functions to specifically bind the antigen or target protein, in a similar manner as compared to the non-fused antigen-binding domain. The concept is built around the particular examples applying the unique properties of immunoglobulin or immunoglobulin-like domains, being fused to a scaffold protein, to create novel unique antigen-binding chimera demonstrating more rigid non-flexible connections. A classical junction of polypeptide components, while typically unjoined in their native state, is performed by joining their respective amino (N-) and carboxyl (C-) termini directly or through a peptide linkage to form a single continuous polypeptide. These fusions are often made via flexible linkers, or at least connected in a flexible manner, which means that the fusion partners are not in a stable position or conformation with respect to each other. As presented in FIG. 1, by linking proteins via the N- and C-terminal ends, a simple linear concatenation, the fusion is easy, but may be non-stable, prone to degradation, and in some case therefore not suitable for therapeutic use. On the other hand, a rigid chimeric/fusion protein as presented herein, with one or more fusion points or connections within the primary topology of two or more proteins, possesses at least one non-flexible fusion point (FIG. 1). The invention inherently comprises an antigen-binding chimeric protein wherein rotation or bending of the one protein opposed to its fusion partner is prohibited via the creation of several fusions. Through the presence of several fusions within the same chimer, an improved rigidity of the novel chimer of the invention is obtained, and is the result of perfectly designing the fusion sites to allow a fusion that can still retain its antigen-binding domain folding, as well as its function to bind its antigen target. The rigidity of a protein is in fact inherent to the (tertiary) structure of the protein, in this case the novel chimera. It has been shown that increased rigidity can be obtained by altering topologies of known protein folds (King et al., 2015). The rigidity of the fusion created in the antigen-binding chimeric protein of the invention hence provides for a rigidity sufficiently strong to 'orient' or 'fix' the target, though mostly the rigidity will still be lower than the rigidity of the target or antigen itself. The fact that the rigid antigen-binding chimeric protein of the present invention still maintains its antigen-binding functionality, is however a surprising observation, since an interruption of the primary topology, could have resulted in a change in domain or protein folding, impacting tertiary topology and antigen-binding. It has been demonstrated herein that this interruption of primary topology did not affect antigen-binding, leading to the opening of new avenues in the fields involving antibodies and their target proteins. The present invention relates to a novel combination of providing unique next-generation fusion technology, and high affinity and/or conformation-selective antigen-binding potential, to allow non-covalent targeting of proteins. This novel type of antigen-binding chimeric proteins aid in several valuable applications depending on the type of scaffold protein that is used for the generation of the chimer. The advantages are numerous, with a straightforward use in structural biology, to facilitate Cryo-EM and X-ray crystallography, for instance by resolving the recurrent issues of limitation in particle size, preferred orientation, and restricted alignment of fragments, preventing to obtain high resolution structures for smaller proteins. By using this next-generation fusion technology, a leap forward can be foreseen in structural biology, as rigid chaperone tools are now available and at full implementation also to use those tools to develop improved, more firm therapeutic and diagnostic molecules, such as by structure-based drug design and structure-based screening of novel compounds. In fact, when used in conformation-selective recognition of antigens or targets, these tools are applicable as well in binding modes that stabilize the target in a functional conformation, such as an active conformation, more specifically an agonist, partial agonist or biased agonist conformation. Furthermore, several examples are known of fusion protein drugs including Enbrel® (tumor necrosis factor/Fc-IgG1), and Nplate® (thrombopoietin/Fc-IgG1), approved by the FDA. In view of therapeutical development of single domain antibodies, the binding to pre-existing antibodies is a commonly known hurdle, for which the antigen-binding chimera of the invention may provide a unique solution. In addition, the antigen-binding chimeric proteins of the invention provide for novel solutions in the field of biologicals and protection agents in the Crop protection industry as well. The development of camelid binding domains directed against pests' and pathogens' essential molecules demonstrate a combined highly specific mode of action with a minimized risk of effects on wildlife, bees, growers and consumers. Such protection agents developed from the antigen-binding chimera of the invention provide for additional advantages, while retaining its cost-effective manner of large-scale manufacturing.

Further application of the antigen-binding chimeric proteins of the invention are found in antigen-binding domains based on the Nbs described to specifically stabilize druggable signaling conformations to enable screening for pathway-selective agonists.

With the rapid advancement of such technologies in biotechnology, it is foreseeable that the invention will impact the creation of novel protein therapeutics and in improved performance of current protein drugs.

In a first aspect, the invention relates to an antigen-binding chimeric protein comprising an antigen-binding domain that is fused with a scaffold protein, wherein said scaffold protein is connected to said antigen-binding domain so that it interrupts the topology of said antigen-binding domain via a fusion at at least one or more amino acid sites accessible in said antigen-binding domain fold. Said antigen-binding chimeric protein is further characterized in that it retains its antigen-binding functionality in a similar manner as compared to the antigen-binding domain not fused to said scaffold protein, in its natural or wild type form. So in one embodiment, said antigen-binding chimeric protein is a conformation-selective binding domain. An embodiment provides an antigen-binding chimeric protein wherein the antigen-binding domain is fused with the scaffold protein in such a manner that the scaffold protein is "interrupting" the antigen-binding domain its topology. In general, the "topology" of a protein refers to the orientation of regular secondary structures with respect to each other in three-dimensional space. Protein folds are defined mostly by the polypeptide chain topology (Orengo et al., 1994). So at the most fundamental level, the 'primary topology' is defined as the sequence of secondary structure elements (SSEs), which is responsible for protein fold recognition motifs, and hence secondary and tertiary protein/domain folding. So in terms of protein structure, the true or primary topology is the sequence of SSEs, i.e. if one imagines of being able to hold the N- and C-terminal ends of a protein chain, and pull it out straight, the topology does not change whatever the protein fold. The protein fold is then described as the tertiary topology, in analogy with the primary and tertiary structure of a protein (also see Martin, 2000). The antigen-binding domain of the antigen-binding chimeric protein of the invention is hence interrupted in its primary topology, by introducing the scaffold protein fusion, but unexpectedly said antigen-binding domain retained its tertiary structure allowing to retain its functional antigen-binding capacity.

The "scaffold protein" refers to any type of protein which has a structure allowing a fusion with another protein, in particular with an antigen-binding domain, as described herein. Such a "scaffold", "junction" or "fusion partner" protein preferably has at least one exposed region in its tertiary structure to provide at least one accessible site to cleave as fusion point for the antigen-binding domain. The scaffold polypeptide is used to assemble with the antigen-binding domain and thereby results in the antigen-binding chimeric protein in a docked configuration to increase mass, provide symmetry, and/or provide a label, and/or add additional antigen-binding sites, and/or increase the half-life, and/or reduce immunogenicity, and/or improve or add a functionality to the antigen-binding domain. So, depending on the type of scaffold protein that is used, a different purpose of the resulting antigen-binding chimeric protein is foreseen. The type and nature of the scaffold protein is irrelevant in that it can be any protein, and depending on its structure, size, function, or presence, the scaffold protein fused with said antigen-binding domain as in the antigen-binding chimeric protein of the invention will be of use in different application fields. The structure of the scaffold protein will impact the final chimeric structure, so a person skilled in the art should implement the known structural information on the scaffold protein and take into account reasonable expectations when selecting the scaffold. Examples of scaffold proteins are provided in the Examples of the present application, and a non-limiting number of proteins that are enzymes, membrane proteins, receptors, adaptor proteins, chaperones, transcription factors, nuclear proteins, antigen-binding proteins themselves, such as Nanobodies, among others, may be applied as scaffold protein to create antigen-binding chimeric proteins of the invention. In a preferred embodiment, the 3D-structure of said scaffold proteins is known or can be predicted by a skilled person, so the accessible sites to fuse the antigen-binding domain with can be determined by said skilled person.

The novel chimeric proteins are fused in a unique manner to avoid that the junction is a flexible, loose, weak link/region within the chimeric protein structure. A convenient means for linking or fusing two polypeptides is by expressing them as a fusion protein from a recombinant nucleic acid molecule, which comprises a first polynucleotide encoding a first polypeptide operably linked to a second polynucleotide encoding the second polypeptide, in the classical known manner. In the recombinant nucleic acid molecule of the present invention however, the interruption of the topology of the antigen-binding domain by said scaffold is also reflected in the design of the genetic fusion from which said antigen-binding chimeric protein is expressed. So, in one embodiment, the antigen-binding chimeric protein is encoded by a chimeric gene formed by recombining parts of a gene encoding for an antigen-binding domain, and parts of a gene encoding the scaffold protein, wherein said encoded scaffold protein interrupts the primary topology of the encoded antigen-binding domain at one or more accessible sites of said domain via at least two or more direct fusions or fusions made by encoded peptide linkers. So, the polynucleotides encoding the polypeptides to be fused are fragmented and recombined in such a way to provide the antigen-binding chimeric protein that provides a rigid non-flexible link, connection or fusion between said proteins. The novel chimera are made by fusing the scaffold protein with the antigen-binding domain in such a manner that the primary topology of the antigen-binding domain is interrupted, meaning that the amino acid sequence of the antigen-binding domain is interrupted at accessible site(s) and joined to the accessible amino acid(s) of the scaffold protein, which sequence is therefore also possibly interrupted. The junctions are made intramolecularly, in other words internally within the amino acid sequences (see Examples and Figures). So, the recombinant fusions of the present invention result in chimera not solely fused at N- or C-termini, but comprising at least one internal fusion site, where the sites are fused directly or fused via a linker peptide. Where a circularly permutated scaffold is applied to produce the antigen-binding chimeric protein, the amino acid sequence of said scaffold protein will be changed by connecting the N- and C-terminus, followed by a cleavage or separation of the amino acid sequence at another site within the sequence of the scaffold protein, corresponding to an accessible site in its tertiary structure, to be fused to the amino acid sequence of the antigen-binding domain parts. Said N- and C-terminus connection for obtaining the circular permutation may be through a direct fusion, a linker peptide, or even via a short deletion of the region near N- and C-terminus followed by peptide bond of the ends.

The term "accessible site(s)", "fusion site(s)" or "fusion point" or "connection site" or "exposed site", are used interchangeably herein and all refer to amino acid sites of the protein sequence that are structurally accessible, preferably positions at the surface of the protein, or exposed to the surface. A person skilled in the art will be able to determine those sites. The antigen-binding sites of antigen-binding domains often concern exposed regions, such as for instance the CDRs of an Ig domain. However, the interruption of those sites for fusing the antigen-binding domain to the scaffold protein may lead to loss of antigen-binding capacity, which is not suitable for the antigen-binding chimeric proteins of the invention, and hence not intended to be applied here as accessible fusion site. So, with 'accessible sites' and 'exposed regions' as 'loops' or 'beta turns' as described herein is meant those sites and regions that are not the antigen-binding sites or regions, hence not the CDRs. The N-terminus or C-terminus of the protein is in most cases also a "loose" end of the protein 3D-structure, and therefore accessible from the surface. These can be considered as an accessible site in the chimera of the invention, on the condition that at least one other accessible site in the antigen-binding domain is used for fusion, which leads to an interruption/insertion at that accessible site, interrupting the topology, as this latter accessible site fusion will provide rigidity to the novel chimer. So, accessible sites can therefore include amino- and/or carboxy-terminal sites of the proteins, but the chimer cannot be exclusively based on fusion from accessible sites made up of N- or C-termini. At least one or more sites of the antigen-binding domain are used for fusion to the scaffold protein as to result in an interruption of the topology of the known conventional domain fold. So, in one embodiment the at least one accessible site is not an N-terminal and/or C-terminal site of said domain if the at least one is one, and/or does not include an N- or C-terminal site of said domain. In a particular embodiment, the at least one site is not an N- or C-terminal amino acid of said domain. In another embodiment, the accessible site can be an N- or C-terminal site of the antigen-binding domain, when at least more than one site is used to be fused to the scaffold protein. The scaffold protein is fused via accessible sites visible from its tertiary structure as well, for which in one embodiment, said at least one site is not an N- or C-terminal end of the scaffold protein, and in an alternative embodiment, the at least one site is the N- or C-terminal end of said scaffold.

In some embodiments, the antigen-binding chimer comprises the N-terminal fragment of said scaffold protein fused at an interruption in an exposed region of said antigen-binding domain, and the C-terminal fragment of said scaffold protein fused to the C-terminal end of said antigen-binding domain.

In some embodiments of the invention, the fusions can be direct fusions, or fusions made by a linker peptide, said fusion sites being immaculately designed to result in a rigid, non-flexible fusion protein. In addition to the position of the selected accessible site(s), the length and type of the linker peptide contributes to the rigidity of the resulting chimeric protein. Within the context of the present invention, the polypeptides constituting the antigen-binding chimeric protein are fused to each other directly, by connection via a peptide bond, or indirectly, whereby indirect coupling assembles two polypeptides through connection via a short peptide linker. Preferred "linker molecules", "linkers", or "short polypeptide linkers" are peptides with a length of maximum ten amino acids, more likely four amino acids, typically is only three amino acids in length, but is preferably only two or even more preferred only a single amino acid to provide the desired rigidity to the junction of fusion at the accessible sites. Non-limiting examples of suitable linker sequences are described in the Example section, which can be randomized, and wherein linkers have been successfully selected to keep a fixed distance between the structural domains, as well as to maintain the fusion partners their independent functions (e.g. antigen-binding). In the embodiment relating to the use of rigid linkers, these are generally known to exhibit a unique conformation by adopting α-helical structures or by containing multiple proline residues. Under many circumstances, they separate the functional domains more efficiently than flexible linkers, which may as well be suitable, preferably in a short length of only 1-4 amino acids.

In one embodiment, the accessible site(s) of the antigen-binding domain are in an exposed region of the domain fold. Said exposed regions are identified as less fixed amino acid stretches, that are mostly located at the surface of the protein, and on the edges of a structure. Preferably exposed regions are present as loops or βturns of a protein structure.

In a particular embodiment, said antigen-binding chimeric protein comprises an antigen-binding domain with at least 7 anti-parallel β-strands, mostly occurring as p sheet(s), and at least 3 β-turns, the latter also being considered as exposed regions. In one embodiment, said antigen-binding domain of at least 7 anti-parallel β-strands, and at least 3 β-turns, comprises an immunoglobulin-like domain, such as in particular the antigen-binding domain of a Monobody. Monobodies are synthetic binding proteins that are constructed using a fibronectin type III domain (FN3) as a molecular scaffold. The native FN3 scaffold consists of 94 amino acids and has a molecular mass of about 10 kDa, comparable to the size of a single variable domain of an antibody. They are based on the structure of human fibronectin, more specifically on its tenth extracellular type III domain. This domain has a structure similar to antibody variable domains, with seven β-strands and three exposed loops on each side. In another particular embodiment, said antigen-binding chimeric protein comprises an antigen-binding domain that is an immunoglobulin (Ig) domain. The immunoglobulin (Ig) domain is a type of protein domain that consists of a 2-layer sandwich of 7-9 antiparallel β-strands arranged in two β-sheets with a Greek key topology, consisting of about 125 amino acids. The variable (V) and constant (C) subunits of immunoglobulins differ in the number and regularity of the β strands forming the bilayer: the C domains are built up from seven p strands arranged such that four strands form one 1 sheet and three strands form a second sheet, whereas the V domains contain nine p strands instead of seven. The two additional strands in V domains, inserted at the edge of one p sheet, are functionally important since they define the second hypervariable region directly involved in the formation of the antigen-recognition site. By interrupting the topology of the antigen-binding domain to obtain the antigen-binding chimeric protein of the invention, surprisingly, the immunoglobulin or immunoglobulin-like fold was maintained in the resulting chimeric protein, as well as its functionality to bind the target protein or antigen.

With respect to the antigen-binding domain or Ig domain-containing protein where the scaffold protein is fused to, the nature of the antigen or target of the antigen-binding or Ig domain may be of any kind. The nature of the target is therefore not relevant to the invention, and any epitope that specifically binds the antigen-binding site, or CDRs of the antigen-binding domain, or Ig or Ig-like domain, respectively, can be considered as a valid target protein. The target can be, as a non-limiting example, a monomeric protein, another macromolecular structure, a multimer, a protein complex, or a transient protein-protein interaction. The target may have any functionality as well, for instance, but not limited to a function as enzyme, membrane protein such as GPCR, ion-channel, but also nuclear and other receptor proteins, among others can be targets of said antigen-binding domain. Alternatively, the source of the target may be of any origin, which is found for instance but not limited to an origin in human, mammalian, or animals, but also in bacteria, viruses, insects, among others.

In one embodiment, the antigen of the antigen-binding or Ig/Ig-like domain is not the scaffold protein that is fused to said antigen-binding or Ig/Ig-like domain to result in the antigen-binding chimeric protein. More preferably, when a scaffold protein is used to fuse or connect the antigen-binding or Ig domain as described by the present invention, the novel antigen-binding chimeric protein should not specifically bind to the scaffold protein present in its monomeric, native or fused form. Alternatively, an composition of an antigen-binding chimeric protein is disclosed herein, which comprises a first and a second antigen-binding chimeric protein as described herein, wherein the antigen-binding domain of said second antigen-binding chimeric protein specifically binds the scaffold protein of the first antigen-binding chimeric protein. To avoid aggregates or chain-reaction of antigen-binding chimeric proteins binding their own scaffold, the scaffold of said second antigen-binding chimeric protein is different from the scaffold protein of said first antigen-binding chimeric protein. With 'different' is meant herein for the purpose of the invention, that an amino acid mutation, deletion, insertion or substitution or a modification of the scaffold protein of the second antigen-binding chimeric protein results in the non-binding of the antigen-binding domain of the second antigen-binding chimeric protein to said scaffold protein part of the second antigen-binding chimeric protein. Another embodiment relates to said composition of antigen-binding chimeric proteins, in a complex bound with its antigen or target protein.

In an alternative embodiment, an antigen-binding chimeric protein is described as a rigid fusion protein comprising i) a conserved N-terminal amino acid sequence of an immunoglobulin or Ig-like domain, ii) a scaffold protein, and iii) an immunoglobulin domain sequence lacking said conserved N-terminal amino acid sequence of i), wherein i) and iii) are concatenated to said scaffold protein of ii). In a preferred embodiment, said rigid fusion protein comprises a conserved N-terminal amino acid sequence which is a conserved N-terminal domain of the FR1 region, comprising a conserved consensus sequence with residues as in SEQ ID NO:1, or a homologous sequence thereof, with a length between 11 and 15 residues (the end of the N-terminal part between residue 11 and 15 of SEQ ID NO:1 for example, i.e. near the first beta turn).

In another embodiment, the antigen-binding domain of the antigen-binding chimeric protein comprises helical secondary structures. In particular, said antigen-binding domain may be an alphabody, which is part of the antigen-binding domains as antibody mimetic, or may be a DARPin, which is an antibody mimetic with a structure that is very different from immunoglobulin since it contains designed alpha helices that may as well be rigid through the design of rigid helical linkers, which therefore are applicable in fusions as described herein for producing antigen-binding chimeric proteins. However, the antigen-binding properties of antibody mimetics is a synthetically created or predicted binding site, which does not naturally occur, and may therefore be less applicable as compared to an in vivo matured antigen-binding site of for instance single domain antibodies. Moreover, to create rigid fusions using said helical structures or coiled-coils may be more complex as compared to the fusions comprising β-turns as to interfere with the topology The most straightforward identification of "exposed regions" of the Ig domain are the exposed loops, preferably the β-turns, which are exposed loops located at the edges of the β sheet sandwich 3D-structure. Further embodiments imply that the exposed region of said antigen-binding domain comprises a β-turn as defined by IMGT (Lefranc, 2014), wherein said scaffold protein is inserted or fused to said exposed region of an immunoglobulin (variable) domain being: a. the first β-turn that connects beta-strand A and B of said antigen-binding domain; or b. the β-turn that connects beta-strand C and C' of said antigen-binding domain; or c. the β-turn that connects beta-strand C" and D of said antigen-binding domain; or d. the β-turn that connects beta-strand D and E of said antigen-binding domain; or e. the β-turn that connects beta-strand E and F of said antigen-binding domain. In a preferred embodiment, the accessible site(s) are in the exposed region of the AB β-turn, which connects the A and B β-strands of the Ig domain. Alternatively, the accessible sites are positioned in an exposed region defined by the CC' β-turn, connecting the C and C' β-strands of the Ig domain. Another embodiment comprises exposed regions with accessible site(s) in the C"D β-turn, or the EF β-turn.

In fact, those are the surface loops connecting the β-strands A and B, C and C', C" and D, or E and F, respectively, constituting the β-sheets of the typical sandwich to provide the immunoglobulin fold. Most preferably, the accessible sites are in an exposed region, loop or β-turn, so that the CDRs of the Ig domain retain their ability to bind the epitope of the target protein. The CDRs themselves can also be considered as exposed regions, so in theory they are providing accessible sites. However, the antigen-binding chimeric proteins will only be functional, hence antigen-binding, when the target protein can still be bound, which is not likely when amino acids in the CDRs are used as accessible sites for fusion.

In another embodiment, the antigen-binding domain comprises an immunoglobulin-like domain, such as more particular for a monobody, wherein the scaffold protein is inserted, analogously to the option provided above for the Ig domains, in the first β-turn that connects β-strand A and B of said Ig-like domain; or, in the β-turn that connects β-strand C and D of said Ig-like domain; or, in the β-turn that connects 1-strand E and F of said Ig-like domain, more particular, for Monobodies, as defined according to the structure annotated in Koide et al. (2012). Said nomenclature has been adopted based on the VHH Ig-fold annotation.

In another embodiment, the scaffold protein has a circular permutation. In a preferred embodiment, said circular permutation of the scaffold protein is present at the N- and/or C-terminus of the scaffold protein, or most preferably is between the N- and C-terminus of the scaffold protein. Another embodiment provides a scaffold protein comprising at least 2 anti-parallel β-strands.

In one embodiment, a fusion protein (with two peptide bonds or two short linkers) is obtained connecting the immunoglobulin or antigen-binding domain to the scaffold, via interruption of the Ig or antigen-binding domain primary topology at a cleaved accessible site in its sequence corresponding to the AB beta turn, through fusion with a circularly permutated scaffold protein at its cleaved accessible site in its sequence corresponding to an exposed region of its structure (wherein said exposed or accessible site is not N- or C-terminal). So, in the particular embodiment wherein the circular permutation of the scaffold protein is at the N- and C-terminus (as in FIG. 2), the scaffold protein sequence can be recombinantly fused with the antigen-binding protein fragments as a whole (as in FIG. 8). In a particular embodiment, said chimer has its rigidity increased through the additional generation of a strengthening disulfide bridge formed by cysteine residues located within the antigen-binding or Ig domain, preferably near the accessible site of the AB beta turn, at the end of β-strand A, and the end of the β-strand G. In one embodiment, the antigen-binding domain and the scaffold are further connected via a disulphide bond to improve rigidity of the antigen-binding chimeric protein. Most preferably those sites are the last amino acid the A p strand (around residues 11-15 of SEQ ID NO:1 for instance), wherein said residue is replaced by a Cysteine, and one of the last amino acids of the Ig domain also being mutated into a cysteine (see FIG. 10).

In another embodiment, said fusion protein (with two peptide bonds or two short linkers) connecting the immunoglobulin to the scaffold, is obtained via interruption of the Ig domain topology at a cleaved accessible site in its CC' beta turn, through fusion with a circularly permutated scaffold protein at its cleaved accessible site in an exposed region of its structure located within its sequence (that is not N- or C-terminal). So, in a particular embodiment wherein the circular permutation of the scaffold protein is made by connecting the N- and C-terminus (as in FIG. 22), the scaffold protein sequence can be recombinantly fused with the Ig protein fragments as a whole (as in FIG. 8).

In another embodiment, the scaffold protein as described herein is an obligate dimer or multimer, such as a dodecamer, which can be a homo- or hetero-oligomer, and/or a coat protein, or virus-like particle protein, or a fragment thereof. The coat protein, or virus-like particle protein is forming multimers and self-assembles in symmetric structures, leading to a display of the fused Ig domain on the surface of said symmetric structure.

In another embodiment, a fusion or chimeric protein (with three peptide bonds or three short linkers) connecting the immunoglobulin to the scaffold, is obtained via interruption of the antigen-binding or Ig/Ig-like domain topology at a cleaved accessible site in its AB beta turn, through fusion with a scaffold protein at its N-terminal amino acid. Said scaffold protein also requires a structurally accessible site within its sequence, which is cleaved to couple back to the AB beta turn site that allows fusion with β-strand B of the Ig domain. The second accessible site of the Ig domain is provided for instance, but not limited by its C-terminal amino acid, which is further fused to the remaining part of the scaffold protein (see FIG. 11). So, in the particular embodiment wherein the scaffold protein is fused at 2 different accessible sites of the antigen-binding or Ig/Ig-like domain, the scaffold protein sequence requires to be recombinantly fused to the antigen-binding or Ig domain protein fragments as 2 fragments. In a particular embodiment, said chimeric fusion protein with three peptide bonds or short linkers connecting the immunoglobulin to the scaffold, its rigidity is increased through the additional generation of a strengthening disulfide bridge formed by cysteine residues located within the Ig domain. In a particular embodiment, said scaffold protein is an obligate dimer or multimer, or can be a coat protein or virus-like particle, or a fragment thereof, thereby creating symmetry.

In a specific embodiment, the fusion protein (with three peptide bonds or short linkers) connecting the immunoglobulin to the scaffold comprises two scaffold proteins forming a heterodimer. Said fusion protein is obtained via interruption of the Ig domain topology at a cleaved accessible site in its AB beta turn, through fusion with a first circularly permutated scaffold protein at its cleaved accessible site in an exposed region of its structure located within its sequence (that is not N- or C-terminal), which is then at its C-terminal end fused to the same accessible site to make the connection to β-strand B back into the Ig domain. The second accessible site of the Ig domain is provided by its C-terminal amino acid, which is finally fused with the N-terminus of the second scaffold protein, which dimerizes with the first scaffold protein, resulting in increased rigidity. In a particular embodiment, the circular permutation of the scaffold protein is at the N- and C-terminus. So, in the specific embodiment wherein the circular permutation of the first scaffold protein is at the N- and C-terminus, the circularly permutated sequence of the first scaffold protein can be recombinantly fused as a whole with the Ig protein fragments inserted between the N-terminal and C-terminal parts of the Ig sequence (cut within the AB beta turn), and the second scaffold protein is N-terminally fused with the C-terminus of the Ig domain sequence. Hence, the multimeric scaffold protein is connected or fused with the Ig domain its accessible site(s) via each of the monomers of said multimeric scaffold.

In a particular embodiment, the scaffold protein of the fusion protein (with three peptide bonds or short linkers) connecting the antigen-binding domain to the scaffold, comprises a second antigen-binding domain. Said fusion protein is obtained through interrupting the (first) antigen-binding domain topology at a cleaved accessible site in its AB beta turn, by fusion with the (second) antigen-binding domain-comprising scaffold protein at its N-terminal amino acid. Said (second) antigen-binding domain-comprising scaffold protein comprises an Ig domain in a particular embodiment, and offers a structurally accessible site within its sequence, specifically near the C-terminal end of β-strand G, which is cleaved to couple back to the AB beta turn site that allows to fuse with β-strand B of the (first) antigen-binding domain. The second accessible site of the (first) antigen-binding domain is then provided by its C-terminal amino acid, which is finally fused to the remaining part of the (second) antigen-binding Ig domain-comprising scaffold protein (see FIG. 17). So, in this particular embodiment, the (second) antigen-binding domain-comprising scaffold protein sequence requires to be recombinantly fused to the (first) antigen-binding protein fragments as 2 fragments. The two antigen-binding domains fused to one another, as described in this embodiment are in one particular embodiment disclosed as two identical antigen-binding domains, or as different antigen-binding domains binding different epitopes of the same target protein, or even as 2 antigen-binding domains targeting different proteins. The epitope bound by the CDRs of antigen-binding proteins that are Ig domains should however not be present in the other Ig domain that is part of the resulting antigen-binding chimer, or should not be present on the newly formed antigen binding chimer itself. In a particular embodiment, said Ig domains are two Nanobodies, and in more specific embodiments, 2 identical Nbs, or different Nbs binding different epitopes of the same target protein, or even 2 Nbs targeting different proteins. The epitope bound by the Nbs should however not be present in the other Nb that is part of the resulting antigen-binding chimer, or should not be present on the newly formed antigen binding chimer itself.

In certain embodiments, the scaffold protein of the invention is a monomeric protein. In other embodiments, the scaffold protein is a protein providing symmetry, such as a multimeric scaffold protein, or a scaffold protein which is a coat protein or a protein to self-assemble into virus-like particles. Multimeric scaffold proteins provide symmetry via oligomerization, which can be hetero- or homo-oligomerisation, and can be obligate, or permanent, but also transient. The obtained symmetry can be any type of symmetry, such as for example but not limiting, cyclic, cubic, dihedral, hexahedral, octahedral, icosahedral, . . . In particular, the term "icosahedral" refers to a type of symmetry derived from icosahedron, meaning a polyhedron geometric form with 20 faces. The term "virus-like particle" (VLP), "icosahedral VLP proteins", "coat proteins", or "proteins forming icosahedral VLPs", refers to proteins that are capable to self-assemble into multimeric structures, VLPs, derived from a virus, but non-infectious, and providing an (icosahedral) symmetry. Bacteriophages for example have heads with an icosahedral structure. Furthermore, display of a chimeric surface protein comprising all or part of a heterologous protein is easily possible using any icosahedral virus for which a reverse genetics system for the production of virus particles has been established. The chimeric surface protein comprises a viral surface or coat protein fused to a heterologous an antigen-binding domain, as provided by the current invention. The viral coat protein may be fused via a linker sequence or via a peptide bond to serve as a scaffold. In some instances, portions of the viral coat protein are deleted to better accommodate the linker and/or the antigen-binding domain fused to it. Whether a deletion affects the ability of the viral protein to recoat the particles can be assessed by incubating recombinantly expressed viral protein in the presence of viral particles and observe the formation of recoated virus particles.

A further aspect of the invention relates to a novel antigen-binding chimeric protein comprising an antigen-binding domain fused with a scaffold protein, wherein said scaffold protein interrupts the topology of said domain, and wherein the total mass or molecular weight of the scaffold protein(s) is at least 30 kDa, so that the addition of mass by binding of the chimer to the target of the antigen-binding domain will be significant and sufficient to allow 3-dimensional structural analysis of the target when non-covalently bound to said chimer. In another embodiment, the total mass or molecular weight of the scaffold protein(s) is at least 10, at least 20, at least 35, at least 40, at least 45, at least 50, or at least 60 kDa. This particular size or mass increase will affect the signal-to-noise ratio in the images to decrease. Secondly, the chimer will offer a structural guide by providing adequate features for accurate image alignment for small or difficult to crystallize proteins to reach a sufficiently high resolution using cryo-EM and X-ray crystallography.

Another aspect of the invention relates to a novel antigen-binding chimeric protein comprising an antigen-binding domain fused with a scaffold protein, wherein said scaffold protein interrupts the topology of said domain, wherein the scaffold protein further comprises an antigen-binding domain, with in a particular embodiment, said scaffold protein comprising an Ig domain, being a VHH, a Nanobody, or antibody in itself. Said fusion to obtain a novel antigen-binding chimeric protein results hence in an antigen-binding chimeric protein with at least two antigen-binding sites wherein the antigen-binding moieties are fused to result in a rigid chimera, and retain their function to bind their target. Said at least two antigen-binding sites can target the same epitope or a different epitope of one target, thereby increasing affinity and/or efficacy. Alternatively, the two antigen-binding sites of said chimer comprising said two antigen-binding domains fused according to the invention can bind different target proteins, which allows targeting of two proteins using only one rigid chimer. This unique feature of the chimer provides a solution to the therapeutic use of bispecifics when a rigid structure is required for targets that are for instance in close proximity, and otherwise hard to reach.

Also encompassed within the scope of the present invention are antigen-binding domains and/or scaffold proteins that comprise an antigen-binding domain, wherein the antigen-binding domain is in a "multivalent" form and formed by bonding, chemically or by recombinant DNA techniques, together two or more (monovalent) antigen-binding domains, such as Ig domains. Non-limiting examples of multivalent constructs include "bivalent" constructs, "trivalent" constructs, "tetravalent" constructs, and so on. The immunoglobulin domains comprised within a multivalent construct may be identical or different. In particular, the immunoglobulin domains of the invention or the Ig domains constituting the scaffold protein of the invention are then in a "multispecific" form and are formed by connecting two or more immunoglobulin domains, of which at least one with a different specificity. Non-limiting examples of multi-specific constructs include "bi-specific" constructs, "tri-specific" constructs, "tetra-specific" constructs, and so on. To illustrate this further, any multivalent or multispecific (as defined herein) immunoglobulin domains of the invention may be suitably directed against two or more different epitopes on the same antigen, for example against two or more different epitopes of the target; or may be directed against two or more different antigens, for example against an epitope of the target and an epitope of a natural binding partner of the target. In particular, a monovalent immunoglobulin domain of the invention is such that it will bind to the target with an affinity less that is lower than the affinity conferred by the multivalent or multispecific immunoglobulin single variable domains of the invention. In a particular embodiment, such multivalent or multispecific Ig domains of the invention may be fused to each other as an Ig domain and a scaffold protein, by interruption of at least one of the Ig domains its topology. Otherwise, the multivalent of multispecific Ig domains of the invention may be fused in a conventional way, via their N- and/or C-termini, and further be applied as a whole to fuse to another Ig domain and/or to another scaffold, via interruption of the Ig domain where it is fused to, or via interruption of the Ig domain of the multivalent or multispecific Ig domain itself.

Another embodiment provides scaffold proteins that are non-immunoglobulins but that are proteins known to bind another type of protein, and can therefore as well be taken into consideration for therapeutic targeting.

In an alternative aspect, the antigen-binding chimeric protein of the invention comprises modified amino acids. Another embodiment describes a scaffold protein occurring in a modified form, and/or comprising (or being fused with) other moieties. Alternative embodiments describe an antigen-binding domain of the antigen-binding chimeric protein occurring in a modified form, and/or comprising other moieties. Examples of modifications, as well as examples of amino acid residues within the protein domains of the invention that can be modified (i.e. either on the protein backbone but preferably on a side chain), methods and techniques that can be used to introduce such modifications and the potential uses and advantages of such modifications will be clear to the skilled person. For example, such a modification may involve the introduction (e.g. by covalent linking or in another suitable manner) of one or more functional groups, residues or moieties into or onto the binding agent. Examples of such functional groups and of techniques for introducing them will be clear to the skilled person, and can generally comprise all functional groups and techniques mentioned in the art as well as the functional groups and techniques known per se for the modification of pharmaceutical proteins, and in particular for the modification of antibodies or antibody fragments (including ScFv's and single domain antibodies), for which reference is for example made to Remington's Pharmaceutical Sciences, 16th ed., Mack Publishing Co., Easton, PA (1980). Such functional groups may for example be linked directly (for example covalently) to the scaffold protein, or optionally via a suitable linker or spacer, as will again be clear to the skilled person.

In the case an antigen-binding chimeric protein is of potential therapeutic value, one of the most widely used techniques for increasing the half-life and/or reducing immunogenicity of pharmaceutical proteins comprises attachment of a suitable pharmacologically acceptable polymer, such as poly(ethyleneglycol) (PEG) or derivatives thereof (such as methoxypoly(ethyleneglycol) or mPEG). Generally, any suitable form of pegylation can be used, such as the pegylation used in the art for antibodies and antibody fragments (including but not limited to (single) domain antibodies and ScFv's); reference is made to for example Chapman, Nat. Biotechnol., 54, 531-545 (2002); by Veronese and Harris, Adv. Drug Deliv. Rev. 54, 453-456 (2003), by Harris and Chess, Nat. Rev. Drug. Discov., 2, (2003) and in WO04060965. Various reagents for pegylation of proteins are also commercially available, for example from Nektar Therapeutics, USA. Preferably, site-directed pegylation is used, in particular via a cysteine-residue (see for example Yang et al., Protein Engineering, 16, 10, 761-770 (2003). For example, for this purpose, PEG may be attached to a cysteine residue that naturally occurs in the scaffold protein, or the scaffold protein may be modified so as to suitably introduce one or more cysteine residues for attachment of PEG, or an amino acid sequence comprising one or more cysteine residues for attachment of PEG may be fused to the N- and/or C-terminus of the scaffold, all using techniques of protein engineering known per se to the skilled person. Preferably, for the scaffold protein of the novel antigen-binding chimeric protein of the invention, a PEG is used with a molecular weight of more than 5000, such as more than 10,000 and less than 200,000, such as less than 100,000; for example in the range of 20,000-80,000. Another, usually less preferred modification comprises N-linked or O-linked glycosylation, usually as part of co-translational and/or post-translational modification, depending on the host cell used for expressing the antigen-binding chimeric protein of the invention. Another technique for increasing the half-life of said antigen-binding chimeric protein may comprise the engineering into bifunctional constructs (for example, one antigen-binding domain against target 1 and one antigen-binding domain present within the scaffold protein against a serum protein such as albumin) or into additional fusions of the antigen-binding chimeric protein, via or as the scaffold protein, with peptides (for example, a peptide against a serum protein such as albumin).

Another aspect of the invention relates to a novel antigen-binding chimeric protein comprising an antigen-binding domain fused with a scaffold protein, wherein said scaffold protein interrupts the topology of said domain, wherein said scaffold protein is a modified protein, that is a labelled protein. Alternatively, said antigen-binding domain is a labelled protein. Yet another modification may comprise the introduction of one or more detectable labels or other signal-generating groups or moieties, depending on the intended use of the labeled antigen-binding chimeric protein. Suitable labels and techniques for attaching, using and detecting them will be clear to the skilled person, and for example include, but are not limited to, fluorescent labels, (such as IRDye800, VivoTag800, fluorescein, isothiocyanate, rhodamine, phycoerythrin, phycocyanin, allophycocyanin, o-phthaldehyde, and fluorescamine and fluorescent metals such as Eu or other metals from the lanthanide series), phosphorescent labels, chemiluminescent labels or bioluminescent labels (such as luminal, isoluminol, theromatic acridinium ester, imidazole, acridinium salts, oxalate ester, dioxetane or GFP and its analogs), radio-isotopes, metals, metals chelates or metallic cations or other metals or metallic cations that are particularly suited for use in in vivo, in vitro or in situ diagnosis and imaging, as well as chromophores and enzymes (such as malate dehydrogenase, staphylococcal nuclease, delta- V-steroid isomerase, yeast alcohol dehydrogenase, alpha-glycerophosphate dehydrogenase, triose phosphate isomerase, biotinavidin peroxidase, horseradish peroxidase, alkaline phosphatase, asparaginase, glucose oxidase, beta-galactosidase, ribonuclease, urease, catalase, glucose-VI-phosphate dehydrogenase, glucoamylase and acetylcholine esterase). Other suitable labels will be clear to the skilled person, and for example include moieties that can be detected using NMR or ESR spectroscopy. Such labeled antigen-binding chimeric protein of the invention may for example be used for in vitro, in vivo or in situ assays (including immunoassays known per se such as ELISA, RIA, EIA and other "sandwich assays", etc.) as well as in vivo diagnostic and imaging purposes, depending on the choice of the specific label. As will be clear to the skilled person, another modification may involve the introduction of a chelating group, for example to chelate one of the metals or metallic cations referred to above. Suitable chelating groups for example include, without limitation, 2,2',2"-(10-(2-((2,5-dioxopyrrolidin-1-yl)oxy)-2-oxoethyl)-1,4,7,10-tetraazacyclododecane-1,4,7-triyl)triacetic acid (DOTA), 2,2'-(7-(2-((2,5-dioxopyrrolidin-1-yl)oxy)-2-oxoethyl)-1,4,7-triazonane-1,4-diyl)diacetic acid (NOTA), diethyl-enetriaminepentaacetic acid (DTPA) or ethylenediaminetetraacetic acid (EDTA). Yet another modification may comprise the introduction of a functional group that is one part of a specific binding pair, such as the biotin-(strept)avidin binding pair. Such a functional group may be used to link the antigen-binding chimeric protein with another protein, polypeptide or chemical compound that is bound to the other half of the binding pair, i.e. through formation of the binding pair. For example, an antigen-binding chimeric protein of the invention may be conjugated to biotin, and linked to another protein, polypeptide, compound or carrier conjugated to avidin or streptavidin. For example, such a conjugated antigen-binding chimeric protein may be used as a reporter, for example in a diagnostic system where a detectable signal-producing agent is conjugated to avidin or streptavidin. Such binding pairs may for example also be used to bind the antigen-binding chimeric protein of the invention to a carrier, including carriers suitable for pharmaceutical purposes. One non-limiting example is the liposomal formulations described by Cao and Suresh, Journal of Drug Targetting, 8, 4, 257 (2000). Such binding pairs may also be used to link a therapeutically active agent to the antigen-binding chimeric protein of the invention. In addition, the use of a toxic label, or radionuclide, to use as a pay-load is also within the scope of said antigen-binding chimeric proteins. Finally, the use of a "label" or "tag" linked or fused to the scaffold protein offers the advantage that the target protein of the Ig domain can be non-covalently labeled.

A further aspect of the invention relates to a nucleic acid molecule encoding said antigen-binding chimeric protein of the present invention. Said nucleic acid molecule comprises the coding sequence of said antigen-binding domain and said scaffold protein(s), and/or fragments thereof, wherein the interrupted topology of said domain is reflected in the fact that said domain sequence will contain an insertion of the scaffold protein sequence(s) (or a circularly permutated sequence, or a fragment thereof), so that the N-terminal antigen-binding domain fragment and C-terminal antigen-binding domain fragment are separated by the scaffold protein sequence or fragments thereof within said nucleic acid molecule.

In another embodiment, a chimeric gene is described with at least a promoter, said nucleic acid molecule encoding the antigen-binding chimeric protein, and a 3' end region containing a transcription termination signal. Another embodiment relates to an expression cassette encoding said antigen-binding chimeric protein of the present invention, or comprising the nucleic acid molecule or the chimeric gene encoding said antigen-binding chimeric protein. Said expression cassettes are in certain embodiments applied in a generic format as an immune library, containing a large set of Ig domains to select for the most suitable binders of the target.

Further embodiments relate to vectors comprising said expression cassette or nucleic acid molecule encoding the antigen-binding chimeric protein of the invention. In particular embodiments, vectors for expression in *E. coli* allow to produce the antigen-binding chimeric proteins and purify them in the presence or absence of their targets.

Alternative embodiments relate to host cells, comprising the antigen-binding chimeric protein of the invention, or the nucleic acid molecule or expression cassette or vector encoding the antigen-binding chimeric protein of the invention. In particular embodiments, said host cell further co-expresses the antigen or target protein that specifically binds the antigen-binding domain of said antigen-binding chimeric protein.

Another embodiment discloses the use of said host cells, or a membrane preparation isolated thereof, or proteins isolated therefrom, for ligand screening, drug screening, protein capturing and purification, or biophysical studies.

The present invention providing said vectors further encompasses the option for high-throughput cloning in a generic fusion vector. Said generic vectors are described in additional embodiments wherein said vectors are specifically suitable for surface display in yeast, phages, bacteria or viruses. Furthermore, said vectors find applications in selection and screening of immune libraries comprising such generic vectors or expression cassettes with a large set of different Ig domains, wherein the same N-terminal end of the conserved Ig domain, and the scaffold protein, are fused with the remaining Ig domain sequences provided by the library. So, the differential sequence in said libraries constructed for the screening of novel antigen-binding chimeric protein for specific targets is provided by the difference in the Ig domain sequence, and more particularly in the CDR regions of said Ig domain library.

Another embodiment of the invention relates to a method of producing an antigen-binding chimeric protein according to the invention comprising the steps of (a) culturing a host comprising the vector, expression cassette, chimeric gene or nucleic acid sequence of the present invention, under conditions conducive to the expression of the antigen-binding chimeric protein, and (b) optionally, recovering the expressed polypeptide.

In one embodiment, the vectors of the present invention are suitable to use in a method involving displaying a collection of antigen-binding chimeric proteins, preferably an immune library, at the extracellular surface of a population of cells. Surface display methods are reviewed in Hoogenboom, (2005; *Nature Biotechnol* 23, 1105-16), and include bacterial display, yeast display, (bacterio)phage display. Preferably, the population of cells are yeast cells. The different yeast surface display methods all provide a means of tightly linking each antigen-binding chimeric protein encoded by the library to the extracellular surface of the yeast cell which carries the plasmid encoding that protein. Most yeast display methods described to date use the yeast *Saccharomyces cerevisiae*, but other yeast species, for example, *Pichia pastoris*, could also be used. More specifically, in some embodiments, the yeast strain is from a genus selected from the group consisting of *Saccharomyces, Pichia, Hansenula, Schizosaccharomyces, Kluyveromyces, Yarrowia,* and *Candida*. In some embodiments, the yeast species is selected from the group consisting of *S. cerevisiae, P. pastoris, H. polymorpha, S. pombe, K. lactis, Y. lipolytica,* and *C. albicans*. Most yeast expression fusion proteins are based on GPI (Glycosyl-Phosphatidyl-Inositol) anchor proteins which play important roles in the surface expression of cell-surface proteins and are essential for the viability of the yeast. One such protein, alpha-agglutinin consists of a core subunit encoded by AGA1 and is linked through disulfide bridges to a small binding subunit encoded by AGA2. Proteins encoded by the nucleic acid library can be introduced on the N-terminal region of AGA1 or on the C-terminal or N-terminal region of AGA2. Both fusion patterns will result in the display of the polypeptide on the yeast cell surface.

The vectors disclosed herein may also be suited for prokaryotic host cells to surface display the proteins. Suitable prokaryotes for this purpose include eubacteria, such as Gram-negative or Gram-positive organisms, for example, Enterobacteriaceae such as *Escherichia*, e.g., *E. coli, Enterobacter, Erwinia, Klebsiella, Proteus, Salmonella*, e.g., *Salmonella typhimurium, Serratia*, e.g., *Serratia marcescans,* and *Shigella*, as well as Bacilli such as *B. subtilis* and *B. licheniformis* (e.g., B. licheniformnis 41 P disclosed in DD 266,710 published Apr. 12, 1989), *Pseudomonas* such as *P. aeruginosa,* and *Streptomyces*. One preferred *E. coli* cloning host is *E. coli* 294 (ATCC 31,446), although other strains such as *E. coli* B, *E. coli* X1776 (ATCC 31,537), and *E. coli* W3110 (ATCC 27,325) are suitable. These examples are illustrative rather than limiting. When the host cell is a prokaryotic cell, examples of suitable cell surface proteins include suitable bacterial outer membrane proteins. Such outer membrane proteins include pili and flagella, lipoproteins, ice nucleation proteins, and autotransporters. Exemplary bacterial proteins used for heterologous protein display include LamB (Charbit et al., EMBO J, 5(11): 3029-37 (1986)), OmpA (Freudl, Gene, 82(2): 229-36 (1989)) and intimin (Wentzel et al., J Biol Chem, 274(30): 21037-43, (1999)). Additional exemplary outer membrane proteins include, but are not limited to, FliC, pullulunase, OprF, Oprl, PhoE, MisL, and cytolysin. An extensive list of bacterial membrane proteins that have been used for surface display are detailed in Lee et al., Trends Biotechnol, 21(1): 45-52 (2003), Jose, Appl Microbiol Biotechnol, 69(6): 607-14 (2006), and Daugherty, Curr Opin Struct Biol, 17(4): 474-80 (2007).

Furthermore, to allow an in-depth screening selection, vectors can be applied in yeast and/or phage display, followed FACS and panning, respectively. Display of antigen-binding chimera on yeast cells in combination with the resolving power of fluorescent-activated cell sorting (FACS), for instance, provides a preferred method of selection. In yeast display each antigen-binding protein is for instance displayed as a fusion to the Aga2p protein at ~50.000 copies on the surface of a single cell. For selection by FACS, the labelling with different fluorescent dyes will determine the selection procedure. The antigen-binding chimer-displaying yeast library can next be stained with a mixture of the used fluorescent proteins. Two-colour FACS can then be used to analyse the properties of each antigen-binding chimer that is displayed on a specific yeast cell to resolve separate populations of cells. Yeast cells displaying an antigen-binding chimer that is highly suitable for targeting the protein of interest will bind and can be sorted along the diagonal in a two-colour FACS. The use of vectors for such a selection method is most preferred when screening of antigen-binding chimeric proteins specifically targeting a transient protein-protein interaction or conformation-selective binding is desired for instance. Similarly, vectors for phage display are applied, and used for display of the antigen-binding chimera on the bacteriophages, followed by panning. Display can for instance be done on M13 particles by fusion of the antigen-binding chimera, within said generic vector, to phage coat protein III (Hoogenboom, 2000; Immunology today. 5699:371-378). For selection of antigen-binding proteins specifically binding certain conformations and/or a transient protein-protein interaction for instance, only one of the interacting protomers is immobilized onto the solid phase. Bio-selection by panning of the phage-displayed antigen-binding chimera is then performed in the presence of excess amounts of the remaining soluble protomer. Optionally, one can start with a round of panning on a cross-linked complex or protein that is immobilized on the solid phase.

Another aspect of the invention relates to a complex comprising said antigen-binding chimeric protein, or comprising a composition of antigen-binding chimeric proteins, and antigen or target protein(s), wherein said target protein is specifically bound to the antigen-binding chimeric protein or to the composition of antigen-binding chimeric proteins. More particular, wherein said target protein is bound to the antigen-binding domain of said antigen-binding chimeric protein, even more particular, in the embodiment wherein said antigen-binding domain is an Ig domain, to the CDRs of the Ig domain of said antigen-binding chimeric protein. One embodiment discloses a complex as described herein, wherein the antigen-binding domain is a conformation selective binding domain. More particularly, a complex is disclosed wherein the antigen-binding domain stabilizes the target protein in a functional conformation. More specifically said functional conformation may involve an agonist conformation, may involve a partial agonist conformation, or a biased agonist conformation, among others. Alternatively, a complex of the invention is disclosed, wherein the antigen-binding domain stabilizes the target protein in a functional conformation, wherein said functional conformation is an inactive conformation, or wherein said functional conformation involves an inverse agonist conformation.

Further aspects of the invention relate to a composition comprising said antigen-binding chimeric protein. A "composition" of the invention may be provided in form of a kit comprising a first container comprising lyophilised antigen-binding chimeric protein and a second container comprising a solution for resuspension of the lyophilised proteins. The protein powder may comprise one or more lyoprotectant such as sucrose, dextran, sorbitol and amino acids to stabilise the protein during lyophilisation. Alternatively, the composition is provided in a single container comprising the antigen-binding chimeric protein in suspension or solution. Either solution may contain one or more excipient(s). The solutions are typically water-based. Therefore, purified water may form the main excipient. For example, dilution of the protein to give the desired final concentration will usually be performed with water for injection (WFI). The solution typically contains a buffer. Therefore, further excipients include buffering agents and pH regulators such as sodium citrate, sodium dihydrogen phosphate monohydrate, and sodium hydroxide. In some instances, a thickening agent such as xanthan may be present as a further excipient. A surfactant, in particular a non-ionic surfactant such as polysorbate 80, may also be present. Other excipients include sucrose, sorbitol, inorganic salts, amino acids and vitamins.

This invention also relates to "pharmaceutical compositions" comprising one or more compounds of the invention, in particular, the antigen-binding chimeric protein and a pharmaceutically acceptable carrier or diluent. These pharmaceutical compositions can be utilized to achieve the desired pharmacological effect by administration to a patient in need thereof. The present invention includes pharmaceutical compositions that are comprised of a pharmaceutically acceptable carrier and a pharmaceutically effective amount of a compound, or salt thereof, of the present invention. A pharmaceutically effective amount of compound is preferably that amount which produces a result or exerts an influence on the particular condition being treated. In general, "therapeutically effective amount", "therapeutically effective dose" and "effective amount" means the amount needed to achieve the desired result or results. One of ordinary skill in the art will recognize that the potency and, therefore, an "effective amount" can vary depending on the identity and structure of the compound of the invention. One skilled in the art can readily assess the potency of the compound. By "pharmaceutically acceptable" is meant a material that is not biologically or otherwise undesirable, i.e., the material may be administered to an individual along with the compound without causing any undesirable biological effects or interacting in a deleterious manner with any of the other components of the pharmaceutical composition in which it is contained. A pharmaceutically acceptable carrier is preferably a carrier that is relatively non-toxic and innocuous to a patient at concentrations consistent with effective activity of the active ingredient so that any side effects ascribable to the carrier do not vitiate the beneficial effects of the active ingredient. Suitable carriers or adjuvantia typically comprise one or more of the compounds included in the following non-exhaustive list: large slowly metabolized macromolecules such as proteins, polysaccharides, polylactic acids, polyglycolic acids, polymeric amino acids, amino acid copolymers and inactive virus particles. Such ingredients and procedures include those described in the following references, each of which is incorporated herein by reference: Powell, M. F. et al. ("Compendium of Excipients for Parenteral Formulations" PDA Journal of Pharmaceutical Science & Technology 1998, 52(5), 238-311), Strickley, R. G ("Parenteral Formulations of Small Molecule Therapeutics Marketed in the United States (1999)-Part-1" PDA Journal of Pharmaceutical Science & Technology 1999, 53(6), 324-349), and Nema, S. et al. ("Excipients and Their Use in Injectable Products" PDA Journal of Pharmaceutical Science & Technology 1997, 51 (4), 166-171).

The term "excipient", as used herein, is intended to include all substances which may be present in a pharmaceutical composition and which are not active ingredients, such as salts, binders (e.g., lactose, dextrose, sucrose, trehalose, sorbitol, mannitol), lubricants, thickeners, surface active agents, preservatives, emulsifiers, buffer substances, stabilizing agents, flavouring agents or colorants. A "diluent", in particular a "pharmaceutically acceptable vehicle", includes vehicles such as water, saline, physiological salt solutions, glycerol, ethanol, etc. Auxiliary substances such as wetting or emulsifying agents, pH buffering substances, preservatives may be included in such vehicles.

The antigen-binding chimeric proteins of the invention and a pharmaceutically acceptable carrier can be administered with pharmaceutically acceptable carriers well known in the art using any effective conventional dosage form, including immediate, slow and timed release preparations, and can be administered by any suitable route such as any of those commonly known to those of ordinary skill in the art. For therapy, the pharmaceutical composition of the invention can be administered to any patient in accordance with standard techniques.

For oral administration, the compounds can be formulated into solid or liquid preparations such as capsules, pills, tablets, troches, lozenges, melts, powders, solutions, suspensions, or emulsions, and may be prepared according to methods known to the art for the manufacture of pharmaceutical compositions. The solid unit dosage forms can be a capsule that can be of the ordinary hard- or soft-shelled gelatin type containing, for example, surfactants, lubricants, and inert fillers such as lactose, sucrose, calcium phosphate, and corn starch. In another embodiment, the compounds of this invention may be tableted with conventional tablet bases such as lactose, sucrose and corn starch in combination with binders such as acacia, corn starch or gelatin, disintegrating agents intended to assist the break-up and dissolution of the tablet following administration such as potato starch, alginic acid, corn starch, and guar gum, gum tragacanth, acacia, lubricants intended to improve the flow of tablet granulation and to prevent the adhesion of tablet material to the surfaces of the tablet dies and punches, for example talc, stearic acid, or magnesium, calcium or zinc stearate, dyes, coloring agents, and flavoring agents such as peppermint, oil of wintergreen, or cherry flavoring, intended to enhance the aesthetic qualities of the tablets and make them more acceptable to the patient. Suitable excipients for use in oral liquid dosage forms include dicalcium phosphate and diluents such as water and alcohols, for example, ethanol, benzyl alcohol, and polyethylene alcohols, either with or without the addition of a pharmaceutically acceptable surfactant, suspending agent or emulsifying agent. Various other materials may be present as coatings or to otherwise modify the physical form of the dosage unit. For instance tablets, pills or capsules may be coated with shellac, sugar or both. Dispersible powders and granules are suitable for the preparation of an aqueous suspension. They provide the active ingredient in admixture with a dispersing or wetting agent, a suspending agent and one or more preservatives. Suitable dispersing or wetting agents and suspending agents are exemplified by those already mentioned above. Additional excipients, for example those sweetening, flavoring and coloring agents described above, may also be present.

The pharmaceutical compositions may be in the form of sterile injectable aqueous suspensions. Such suspensions may be formulated according to known methods using suitable dispersing or wetting agents and suspending agents such as, for example, sodium carboxymethylcellulose, methylcellulose, hydroxypropylmethyl-cellulose, sodium alginate, polyvinylpyrrolidone, gum tragacanth and gum acacia; dispersing or wetting agents which may be a naturally occurring phosphatide such as lecithin, a condensation product of an alkylene oxide with a fatty acid, for example, polyoxyethylene stearate, a condensation product of ethylene oxide with a long chain aliphatic alcohol, for example, heptadeca-ethyleneoxycetanol, a condensation product of ethylene oxide with a partial ester derived from a fatty acid and a hexitol such as polyoxyethylene sorbitol monooleate, or a condensation product of an ethylene oxide with a partial ester derived from a fatty acid and a hexitol anhydride, for example polyoxyethylene sorbitan monooleate. The sterile injectable preparation may also be a sterile injectable solution or suspension in a non-toxic parenterally acceptable diluent or solvent. Diluents and solvents that may be employed are, for example, water, Ringer's solution, isotonic sodium chloride solutions and isotonic glucose solutions. In addition, sterile fixed oils are conventionally employed as solvents or suspending media. For this purpose, any bland, fixed oil may be employed including synthetic mono- or diglycerides.

In addition, fatty acids such as oleic acid can be used in the preparation of injectables.

Another aspect relates to the use of the antigen-binding chimeric protein of the present invention or of the use of the nucleic acid molecule, chimeric gene, the expression cassette, the vectors, the complex, or the compositions, in structural analysis of a target protein. In particular, the use of the antigen-binding chimeric protein in structural analysis of a target protein wherein said target protein is a protein specifically bound to said antigen-binding chimeric protein. "Solving the structure" or "structural analysis" as used herein refers to determining the arrangement of atoms or the atomic coordinates of a protein, and is often done by a biophysical method, such as X-ray crystallography or cryogenic electron-microscopy (cryo-EM). Specifically, an embodiment relates to the use in structural analysis comprising single particle cryo-EM or comprising crystallography. The use of antigen-binding chimeric proteins of the present invention in structural biology renders the major advantage to serve as crystallization aids, namely to play a role as crystal contacts and to increase symmetry, and even more to be applied as rigid tools in Cryo-EM, which will be very valuable to solve large structures, but mainly to reduce size barriers coped with today, and finally also to increase symmetry.

Using cryo-EM for structure determination has several advantages over more traditional approaches such as X-ray crystallography. In particular, cryo-EM places less stringent requirements on the sample to be analysed with regard to purity, homogeneity and quantity. Importantly, cryo-EM can be applied to targets that do not form suitable crystals for structure determination. A suspension of purified or unpurified protein, either alone or in complex with other proteinaceous molecules such as an antigen-binding chimeric protein or non-proteinaceous molecules such as a nucleic acid, can be applied to carbon grids for imaging by cryo-EM. The coated grids are flash-frozen, usually in liquid ethane, to preserve the particles in the suspension in a frozen-hydrated state. Larger particles can be vitrified by cryofixation. The vitrified sample can be cut in thin sections (typically 40 to 200 nm thick) in a cryo-ultramicrotome, and the sections can be placed on electron microscope grids for imaging. The quality of the data obtained from images can be improved by using parallel illumination and better microscope alignment to obtain resolutions as high as ~3.3 Å. At such a high resolution, ab initio model building of full-atom structures is possible. However, lower resolution imaging might be sufficient where structural data at atomic resolution on the chosen or a closely related target protein and the selected heterologous protein or a close homologue are available for constrained comparative modelling. To further improve the data quality, the microscope can be carefully aligned to reveal visible contrast transfer function (CTF) rings beyond $\frac{1}{3}$ Å$^{-1}$ in the Fourier transform of carbon film images recorded under the same conditions used for imaging. The defocus values for each micrograph can then be determined using software such as CTFFIND.

Another aspect of the invention relates to a method of determining the 3-dimensional structure of a target protein or protein of interest, comprising the steps of:
(i) Providing an antigen-binding chimeric protein or composition of antigen-binding chimeric proteins of the invention, and the target protein to form a complex, wherein said target protein is specifically bound to said antigen-binding chimeric protein or composition, or providing the complex of the current invention;
(ii) and display said mix or complex in suitable conditions, for structural analysis, wherein the 3D structure of said target protein is determined at high-resolution.

In a specific embodiment, said structural analysis is done via X-ray crystallography. In another embodiment, said 3D analysis comprises Cryo-EM. More specifically, a methodology for Cryo-EM analysis is described here as follows. A sample (e.g. Megabody protein of choice in a complex with a target of interest), is applied to a best-performing discharged grid of choice (carbon-coated copper grids, C-Flat, 1.2/1.3 200-mesh: Electron Microscopy Sciences; gold R1.2/1.3 300 mesh UltraAuFoil grids: Quantifoil; etc.) before blotting, and then plunge-frozen in to liquid ethane (Vitrobot Mark IV (FEI) or other plunger of choice). Data for a single grid are collected at 300 kV Electron Microscope (Krios 300 kV as an example with supplemented phase plate of choice) equipped with a detector of choice (Falcon 3EC direct-detector as an example). Micrographs are collected in electron-counting mode at a proper magnification suitable for an expected Megabody-antigen complex size. Collected micrographs are manually checked before further image processing. Apply drift correction, beam induced motion, dose-weighting, CTF fitting and phase shift estimation by a software of choice (RELION, SPHIRE packages as examples). Pick particles with a software of choice and use them for to 2D classification. Manually-inspected 2D classes and remove false positives. Bin particles accordingly to data collection settings. Generate an initial 3D reference model by applying a proper low-pass filter and generate a number (six as an example) of 3D classes. Use original particles for 3D refinement (if needed use soft mask). Estimate a reconstruction resolution by using Fourier Shell Correlation (FSC)=0.143 criterion. Local resolution can be calculated by the MonoRes implementation in Scipion. Reconstructed cryo-EM maps can be analyzed using UCSF Chimera and Coot software. The design model can be initially fitted using UCSF Chimera and analyzed by software of choice (UCSF Chimera, PyMOL or Coot).

Another advantage of the method of the invention is that structural analysis, which is in a conventional manner only possible with highly pure protein, is less stringent on purity requirements thanks to the use of the antigen-binding chimeric proteins. Such antigen-binding proteins, especially in the case of Nanobodies, will specifically filter out the protein of interest via binding to its epitope, within a complex mixture. The target protein can in this way be trapped, frozen and analysed via cryo-EM.

Said method is in alternative embodiments also suitable for 3D analysis wherein the target protein is a transient protein-protein complex. Additionally, said chimeric antigen-binding molecules can also be applied in a method for determining the 3-dimensional structure of a target to stabilize transient protein-protein interactions as targets to allow their structural analysis.

Another embodiment relates to a method to select or to screen for a panel of antigen-binding chimeric proteins binding to different epitopes of the same target protein, comprising the steps of: (i) designing an immune library of antigen-binding chimeric proteins binding the target protein, and (ii) selecting the antigen-binding chimeric proteins via surface yeast display, phage display or bacteriophages to obtain an antigen-binding chimeric protein panel comprising proteins binding to several epitopes of said target, thereby allowing several conformations of the target protein to be analysed in for instance cryo-EM in separate images.

In another embodiment, said method and said antigen-binding chimeric protein of the invention is used for structure-based drug design and structure-based drug screening. The iterative process of structure-based drug design often proceeds through multiple cycles before an optimized lead goes into phase I clinical trials. The first cycle includes the cloning, purification and structure determination of the target protein or nucleic acid by one of three principal methods: X-ray crystallography, NMR, or homology modeling. Using computer algorithms, compounds or fragments of compounds from a database are positioned into a selected region of the structure. One could use the antigen-binding chimeric protein of the invention to fix or stabilize certain structural conformations of a target. The selected compounds are scored and ranked based on their steric and electrostatic interactions with this target site, and the best compounds are tested with biochemical assays. In the second cycle, structure determination of the target in complex with a promising lead from the first cycle, one with at least micromolar inhibition in vitro, reveals sites on the compound that can be optimized to increase potency. Also at this point, the antigen-binding chimeric protein of the invention may come into play, as it facilitates the structural analysis of said target in a certain conformational state. Additional cycles include synthesis of the optimized lead, structure determination of the new target:lead complex, and further optimization of the lead compound. After several cycles of the drug design process, the optimized compounds usually show marked improvement in binding and, often, specificity for the target. A library screening leads to hits, to be further developed into leads, for which structural information as well as medicinal chemistry for Structure-Activity-Relationship analysis is essential.

In another embodiment, the antigen-binding domain of said antigen-binding chimeric protein used in the method of the invention comprises a Nanobody Ig domain, thereby offering the additional advantage of said method that only average images of correctly folded target proteins will be encompassed because the selection for displayed antigen-binding chimera using Nanobodies reveals mostly binders to conformational epitopes.

Another embodiment relates to a method of identifying (conformation-selective) compounds, comprising the steps of:
i) providing a target protein and an antigen-binding chimeric protein of the invention specifically binding said target protein
ii) providing a test compound
iii) evaluating the selective binding of the test compound to the target protein.

According to a particularly preferred embodiment, the above described method of identifying conformation-selective compounds is performed by a ligand binding assay or competition assay, even more preferably a radioligand binding or competition assay. Most preferably, the above described method of identifying conformation-selective compounds is performed in a comparative assay, more specifically, a comparative ligand competition assay, even more specifically a comparative radioligand competition assay, which is illustrated further in the Example section.

The compounds to be tested can be any small chemical compound, or a macromolecule, such as a protein, a sugar, nucleic acid or lipid. Typically, test compounds will be small chemical compounds, peptides, antibodies or fragments thereof. It will be appreciated that in some instances the test compound may be a library of test compounds. In particular, high-throughput screening assays for therapeutic compounds such as agonists, antagonists or inverse agonists and/or modulators form part of the invention. For high-throughput purposes, compound libraries or combinatorial libraries may be used such as allosteric compound libraries, peptide libraries, antibody libraries, fragment-based libraries, synthetic compound libraries, natural compound libraries, phage-display libraries and the like. Methodologies for preparing and screening such libraries are known to those of skill in the art. The test compound may optionally be covalently or non-covalently linked to a detectable label. Suitable detectable labels and techniques for attaching, using and detecting them will be clear to the skilled person, and include, but are not limited to, any composition detectable by spectroscopic, photochemical, biochemical, immunochemical, electrical, optical or chemical means. Useful labels include magnetic beads (e.g. dynabeads), fluorescent dyes (e.g. all Alexa Fluor dyes, fluorescein isothiocyanate, Texas red, rhodamine, green fluorescent protein and the like), radiolabels (e.g. $^3$H, $^{125}$I, $^{35}$S, $^{14}$C, or $^{32}$P), enzymes (e.g. horse radish peroxidase, alkaline phosphatase), and colorimetric labels such as colloidal gold or colored glass or plastic (e.g. polystyrene, polypropylene, latex, etc.) beads. Means of detecting such labels are well known to those of skill in the art. Thus, for example, radiolabels may be detected using photographic film or scintillation counters, fluorescent markers may be detected using a photodetector to detect emitted illumination. Enzymatic labels are typically detected by providing the enzyme with a substrate and detecting the reaction product produced by the action of the enzyme on the substrate, and colorimetric labels are detected by simply visualizing the colored label. Other suitable detectable labels were described earlier within the context of the first aspect of the invention relating to the chimeric polypeptide of the invention. Thus, according to specific embodiments, the test compound as used in any of the above screening methods is selected from the group comprising a polypeptide, a peptide, a small molecule, a natural product, a peptidomimetic, a nucleic acid, a lipid, lipopeptide, a carbohydrate, an antibody or any fragment derived thereof, such as Fab, Fab' and F(ab')2, Fd, single-chain Fvs (scFv), single-chain antibodies, disulfide-linked Fvs (dsFv) and fragments comprising either a VL or VH domain, a heavy chain antibody (hcAb), a single domain antibody (sdAb), a minibody, the variable domain derived from camelid heavy chain antibodies (VHH or Nanobody), the variable domain of the new antigen receptors derived from shark antibodies (VNAR), a protein scaffold including an alphabody, protein A, protein G, designed ankyrin-repeat domains (DARPins), fibronectin type III repeats, anticalins, knottins, engineered CH2 domains (nanoantibodies), as defined hereinbefore. In one preferred embodiment, high throughput screening methods involve providing a combinatorial chemical or peptide library containing a large number of potential therapeutic ligands. Such "combinatorial libraries" or "compound libraries" are then screened in one or more assays, as described herein, to identify those library members (particular chemical species or subclasses) that display a desired characteristic activity. A "compound library" is a collection of stored chemicals usually used ultimately in high-throughput screening A "combinatorial library" is a collection of diverse chemical compounds generated by either chemical synthesis or biological synthesis, by combining a number of chemical "building blocks". Preparation and screening of combinatorial libraries are well known to those of skill in the art. The compounds thus identified can serve as conventional "lead compounds" or can themselves be used as potential or actual therapeutics.

Another aspect provides the use of said antigen-binding chimeric protein, wherein the scaffold protein is a labelled protein, as a diagnostic tool, or more specifically for in-vivo imaging.

And a final aspect provides said antigen-binding chimeric protein or nucleic acid, vector, complex, or compositions, for use as a medicament. The term "medicament", as used herein, refers to a substance/composition used in therapy, i.e., in the prevention or treatment of a disease or disorder. According to the invention, the terms "disease" or "disorder" refer to any pathological state, in particular to the diseases or disorders as defined herein.

It is to be understood that although particular embodiments, specific configurations as well as materials and/or molecules, have been discussed herein for engineered cells and methods according to the present invention, various changes or modifications in form and detail may be made without departing from the scope and spirit of this invention. The following examples are provided to better illustrate particular embodiments, and they should not be considered limiting the application. The application is limited only by the claims.

EXAMPLES

General

We have designed rigid antigen-binding chimeric proteins built by antigen-binding domains and scaffold proteins, wherein an antigen-binding domain is connected to a scaffold protein via two or three short linkers, or via two or three direct linkages. Depending on the properties of the scaffold, these rigid antigen-binding chimeric proteins serve different applications.

As an example, the 'antigen-binding chimeric proteins' presented herein are also called 'Megabodies' (Mbs or also Mgbs) and are built from immunoglobulin- or immunoglobulin-like domain containing Nanobodies, VHHs, or Monobodies, grafted onto scaffold proteins, particularly large monomeric scaffolds. Those antigen-binding chimera or as specifically used herein Megabodies are instrumental for determining protein structures of (smaller) proteins, and aid in several applications including X-ray crystallography and cryo-EM applications. The Mbs function as next generation crystallization chaperones by reducing the conformational flexibility of the target and by extending the surfaces predisposed to forming crystal contacts, as well as by providing additional phasing information. Furthermore, with those chimera as innovative auxiliary tools, the size-barrier to obtain high-resolution structures using Cryo-EM has been reduced. By mixing a specific Megabody antigen-binding chimeric protein with its target, their specific binding interaction leads to "mass" addition is acquired and defined features to the particles are embedded on the grid in vitreous ice, facilitating accurate image alignment and improving the resolution of the of the 3D reconstruction. An additional advantage of the use of such antigen-binding chimeric proteins such as Mbs is that they selectively bind conformational epitopes in a one-to-one ratio, facilitating particle classification and thereby improving the structural/conformational homogeneity of the classified particles and improving the resolution of the of the 3D reconstruction. Significant, a set of different Mbs that are alike, but binding on different epitopes on the same protein can be used/combined to prepare different particles from the same macromolecular complex.

Figure 2:
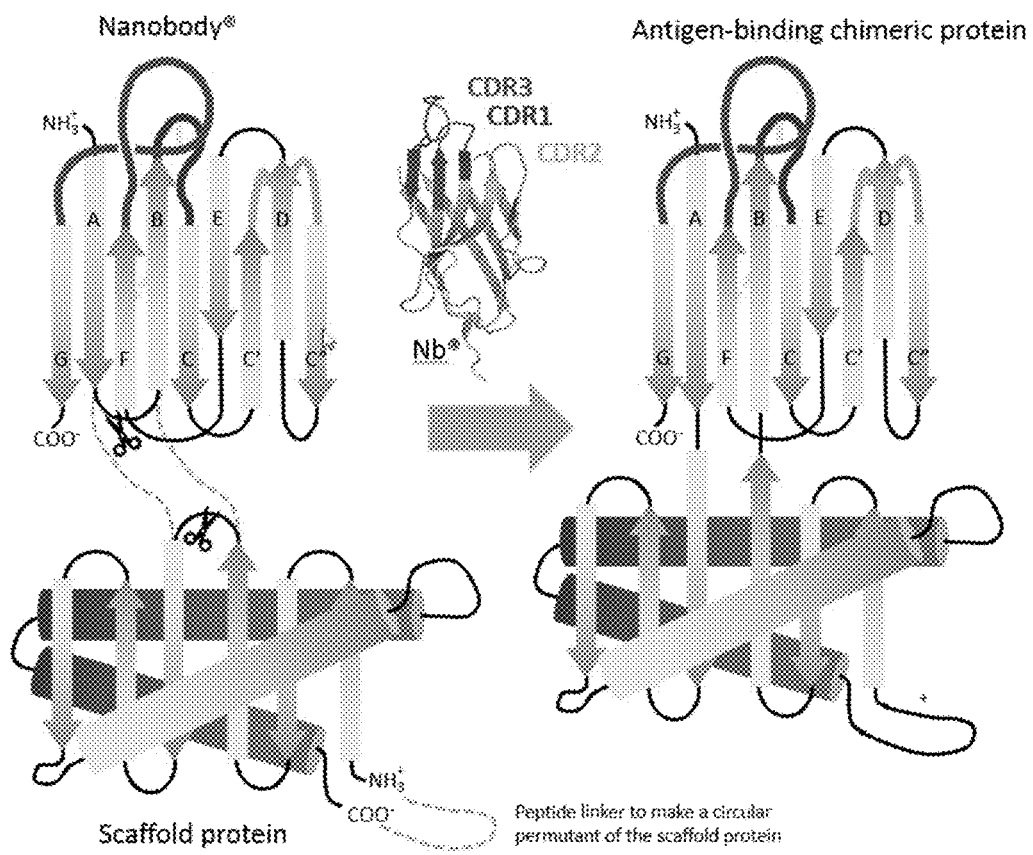
FIG. 2. Engineering principles of an antigen-binding chimeric protein built from a circularly permutated variant of a scaffold protein that is inserted into the first β-turn connecting β-strands A and B of a Nanobody.

As a proof of concept of this approach, we inserted a circularly permutated variant (cHopQ) of the gene encoding the adhesion domain of HopQ (a periplasmic protein from *H. pylori*, PDB 5LP2) in the first exposed β-turn (connecting β-strands A and B) of a GFP-specific Nanobody according to FIG. 2 (Example 1). We expressed this chimer as a secreted protein in the periplasm of *E. coli* and purified it to homogeneity in mg amounts (Example 2). Next, we confirmed that this chimeric antibody binds GFP and solved its structure by X-ray crystallography (Example 3). Using the same scaffold, we also made antigen-binding chimeric proteins that stabilize protein complexes (Example 4), antigen-binding chimeric proteins that bind GPCRs (Example 5) and antigen-binding chimeric proteins that bind ion channels (Example 6; and Example 22). Moreover, the Example 5 revealed that conformation-selective stabilization can be obtained, thereby preserving all functional properties of the Nb or antigen-binding domain from which the Megabody is built. We also used in vitro evolution techniques to design other functional HopQ-based Megabodies via two short polypeptide linkages that vary in linker length and linker composition (Example 7). To show that other large scaffold proteins can also be used to build Megabodies, we next inserted a circularly permutated variant of the gene encoding YgjK (PDB 3W7S), a 86 kDA periplasmic protein of *E. coli* in the first β-turn connecting β-strands A and B of a GFP-specific Nanobody via two short polypeptide linkages that vary in length and composition (Example 8). We also showed that a disulphide bond can be engineered between one of the linker peptides and the C-terminus of the Nanobody to rigidify Megabodies (Example 9). Other rigid antibody chimera built from Nbs that are connected to the scaffold via more complex linking schemes were also constructed. Using in vitro evolution, we fused a GFP-specific Nanobody to Azurin (PDB 2TSA) via three short polypeptide linkages that vary in length and composition. Azurin is a copper containing single domain protein to be used for phasing by anomalous scattering in X-ray crystallography (Example 10). The resulting antigen-binding chimeric proteins herein described as Megabodies showed to enable structural studies of proteins or complexes by X-ray crystallography and single-particle cryo-EM. Similarly, antigen-binding domains can be rigidly coupled to multimeric scaffolds with structural symmetry resulting in multimeric antigen-binding chimeric proteins or multimeric Megabodies with structural symmetry. To proof this principle, a lyzosyme-binding Nb was grafted onto SusB, the inverting glycosidase hydrolase homo-dimer of *B. thetaiotaomicron* (PDB 3WFA) via three short polypeptide linkers that connect Nanobody to scaffold (Example 11). Such homo-dimeric Mbs with two-fold symmetry allow to exploit symmetry restrains in cryo-EM or X-ray crystallography, facilitating the determination of protein structures at high resolution. In another example, we produced virus-like particles (VLPs) displaying Nanobodies from antigen-binding chimeric proteins built from Nbs that are rigidly fused to the coat protein of PP7 or to the AP205, which is a naturally-occurring circularly permutated PP7. PP7 is an icosahedral bacteriophage of *P. Aeruginosa*. VLPs derived from PP7 encapsulate the mRNAs that direct their synthesis, thus establishing the genotype/phenotype linkage necessary for affinity-selected sequences of antigen specific Nbs. Accordingly, we applied in vitro evolution techniques for the design of robust VLPs that display 90 Nbs on their surface in a highly symmetric arrangement (Examples 12-15). These Nanobody-displaying VLPs are excellent tools to solve structures of small proteins by cryo-EM.

Antigen-binding domains such as immunoglobulins can also by rigidly grafted onto scaffolds that can be labelled with a fluorophore, dye, ion or metal to be used in diagnosis, imaging or in other biophysical applications. In Example 10, we fused a GFP-specific Nanobody to Azurin (PDB 2TSA), a copper containing single domain protein to be used for phasing by anomalous scattering in X-ray crystallography.

We also rigidly grafted a GFP-binding Nanobody to Acyl carrier protein (ACP) (Example 16). ACP is a protein that can be orthogonally labelled in a single enzymatic step with a covalent fluorophore.

Immunoglobulin domains can also be rigidly fused via three short peptide linkers to an identical Ig domain or a different Ig domain (or even a different therapeutic scaffold) to produce bivalent or bispecific antigen-binding chimeric proteins, respectively (Nano2bodies, N2b, Examples 17 & 18). Bivalent or bispecific antigen-binding chimeric proteins can be used as chaperones in X-ray crystallography or cryo-EM but have also multiple applications in biophysical applications, imaging, diagnosis and therapy.

As β-strand A is contained in a highly conserved N-terminal sequence that is common to all Nbs (Harmsen et al., 2000), exhaustive in vivo-matured Nanobody repertoires can conveniently be cloned as rigid antigen-binding chimeric protein libraries (comprising antigen-binding chimeric proteins such as the herein called Megabodies, Nanotools or Nano2bodies) and screened by standard methods for binders.

Functional antigen-binding chimeric proteins are then to be selected by phage display, yeast display or viral display (Example 19).

We also constructed rigid antigen-binding chimeric proteins from a circularly permutated variant of the gene encoding the adhesion domain of HopQ (a periplasmic protein from *H. pylori*; the circularly permutated variant herein called 'cHopQ') that is inserted in the second exposed β-turn (connecting β-strands C and C') of a GFP-specific Nanobody (Example 20) and produced an antigen-binding chimeric protein built from synthetic immunoglobulin-like antigen-binding proteins like Monobodies (Example 21).

Moreover, several of the designed and produced antigen-binding chimeric proteins have been applied for structural analysis of intractable membrane-bound complexes such as GPCRs, ion channels, and tyrosine receptor kinases (Example 22).

Another example demonstrated that by producing an antigen-binding chimeric protein or Megabody derived from a Megabody that binds to the cHopQ scaffold protein, an certain composition of antigen-binding chimeric proteins or 'Polybody' is formed, to further enlarge the scaffold size (Example 23).

Example 24 shows that multimeric antigen-binding chimeric proteins can be built from Dodecin protein inserted into the first β-strand AB of a Nb. And finally, also a disulfide-bridged homodimer was tested as a scaffold protein for producing another format of an antigen-binding chimeric protein with increased mass and symmetry (Example 25).

Example 1: Design and Generation of a 58 kD Antigen-Binding Chimeric Protein Built from a cHopQ Scaffold Inserted into the First β-Strand AB-Connecting β-Turn of a GFP-Specific Nanobody As a first proof of concept of obtaining rigid antigen-binding chimeric proteins, such as Megabodies, a Nanobody was grafted onto a large scaffold protein via two peptide bonds that connect Nanobody to scaffold according to FIG. 2 to build a rigid Megabody.

The 58 kDa Megabody described here is a chimeric polypeptide concatenated from parts of single-domain immunoglobulin and parts of a scaffold protein connected according to FIGS. 2 and 3. Here, the immunoglobulin domain used is a GFP-binding Nanobody as depicted in SEQ ID NO:1. The scaffold protein is an adhesin domain of *Helicobacter pylori* strain G27 (PDB: 5LP2, SEQ ID NO:19) called HopQ (Javaheri et al, 2016). The N- and C-terminus of HopQ was connected to allow the creation of a circularly permutated variant of HopQ, called cHopQ, wherein a cleavage of the sequence was made somewhere else in its sequence. To design the $Mb_{Nb207}^{cHopQ}$ construct, all parts were connected to each other from the amino (N-) to the carboxy (C-)terminus in the next given order by peptide bonds (SEQ ID NO:20): β-strand A of the anti-GFP-Nanobody (1-13 of SEQ ID NO: 1), a C-terminal part of HopQ (residues 192-414 of SEQ ID NO:19), a short peptide linker (SEQ ID NO:21) connecting the C-terminus and the N-terminus of HopQ to produce a circular permutant cHopQ of the scaffold protein, an N-terminal part of HopQ (residues 14-186 of SEQ ID NO:19), β-strands B to G of the GFP-binding Nanobody (residues 16-126 of SEQ ID NO:1), 6×His tag and EPEA tag (U.S. Pat. No. 9,518,084 B2; SEQ ID NO:209).

To demonstrate that $Mb_{Nb207}^{cHopQ}$ (SEQ ID NO:20) can be expressed as a well folded and functional protein, we displayed this protein on the surface of yeast (Boder, 1997) and examined the specific binding of the cognate antigen (GFP) to yeast cells displaying this Megabody by flow cytometry. In order to display the $Mb_{Nb207}^{cHopQ}$ on yeast, we used standard methods to construct an open reading frame that encodes the Megabody in fusion to a number of accessory peptides and proteins (SEQ ID NO:22): the appS4 leader sequence that directs extracellular secretion in yeast (Rakestraw, 2009), $Mb_{Nb207}^{cHopQ}$, a flexible peptide linker, the Aga2p the adhesion subunit of the yeast agglutinin protein Aga2p which attaches to the yeast cell wall through disulfide bonds to Aga1p protein, an acyl carrier protein for the orthogonal fluorescent staining of the displayed fusion protein (Johnsson, 2005) followed by the cMyc Tag. This open reading frame was put under the transcriptional control of galactose-inducible GAL1/10 promotor into the pCT-CON2 vector (Chao, 2006) and introduced into yeast strain EBY100.

EBY100 yeast cells, bearing this plasmid, were grown and induced overnight in a galactose-rich medium to trigger the expression and secretion of the $Mb_{Nb207}^{cHopQ}$-Aga2p-ACP fusion. For the orthogonal staining of ACP, cells were incubated for 1 h in the presence a fluorescently labelled CoA analogue (coA-647, 2 μM) and catalytic amounts of the SFP synthase (1 μM). We found that expression of $Mb_{Nb207}^{cHopQ}$ on the surface of yeast is induced by changing growing conditions from glucose-rich to galactose-rich media (FIG. 4). The surface display level can be easily and quantitively analysed by flow cytometry. In these experiments, induced yeast cells were washed and subjected to flow-cytometry to measure the Mb display level of each cell by comparing the CoA647-fluorescence level to yeast cells that do not display the Megabody but were stained orthogonally in the same way. Distinguishable yeast cells with a high CoA647-fluorescence signal were only detected in cultures expressing the $Mb_{Nb207}^{cHopQ}$, indicating that the Megabody can efficiently be displayed and orthogonally stained on the surface of yeast (FIG. 4).

To analyse the functionality of the displayed Megabody, we examined its binding to the cognate antigen (GFP) by flow cytometry. EBY100 yeast cells were induced and fluorescently stained orthogonally with CoA647 to monitor for $Mb_{Nb207}^{cHopQ}$-Aga2p-ACP fusion display, as described above. These orthogonally stained yeast cells were next incubated 1h in the presence of 100 nM GFP (Scholz et al., 2000). After washing these cells, we observed detectable amounts of GFP bound to the displayed $Mb_{Nb207}^{cHopQ}$, which should be linearly correlated to expression level of $Mb_{Nb207}^{cHopQ}$ on the surface of yeast. Indeed, a two-dimensional flow cytometric analysis confirmed that GFP (high GFP-fluorescence level) only binds to yeast cells with significant Megabody display levels (high CoA647-fluorescence level) (FIG. 5). In contrast, GFP does not bind to wild type yeast cells that have been stained in the same way but do not express the $Mb_{Nb207}^{cHopQ}$. We conclude from these experiments that $Mb_{Nb207}^{cHopQ}$ can be expressed as a well folded and functional antigen-binding (GFP-binding) chimeric protein on the surface of yeast.

Example 2: Expression, Purification and Characterization of a 58 kD Antigen-Binding Chimeric Protein Built from a cHopQ Scaffold Inserted into the First β-Strand AB-Connecting β-Turn of a GFP-Specific Nanobody Next, we set out to express this 58 kDa $Mb_{Nb207}^{cHopQ}$ in the periplasm of *E. coli*, purified this to homogeneity and determined its properties. In order to express Megabodies like $Mb_{Nb207}^{cHopQ}$ (SEQ ID NO:20) in the periplasm of *E. coli*, we used standard methods to construct a cloning vector (called pMESD2) that allows the expression of any desired Megabody that is built from (a circularly permutated variant of) HopQ inserted into the first β-turn connecting the very conserved β-strand A, and β-strand B of any Nanobody. This vector is a derivative of pMES4 (Pardon, 2014) and contains an open reading frame that encodes the following polypeptides: the DsbA leader sequence that directs the secretion of the Megabody to the periplasm of *E. coli*, β-strand A of $Nb_{GFP}207$, representing an extremely conserved FR1 part of Nanobodies, a circularly permutated variant of HopQ, called cHopQ, the 6×His tag and the EPEA tag followed by the Amber stop codon. The C-terminal part of any Nanobody (from β-strand B to β-strand G) can be cloned as a SapI fragment in this vector.

In order to express $Mb_{Nb207}^{cHopQ}$ in the periplasm of *E. coli* and purify this recombinant protein to homogeneity, a DNA fragment encoding $Nb_{GFP}207$ from β-strand B to G (nucleotides 52-378 of SEQ ID NO:121) was amplified by PCR (with primers SEQ ID NO:122 and SEQ ID NO:123) and cloned as a SapI fragment in pMESD2 vector that directs the expression of His-tagged and EPEA-tagged $Mb_{Nb207}^{cHopQ}$ in the periplasm of *E. coli* under the transcriptional control of the Plac promotor.

WK6 bacterial cells (WK6 is a su⁻ nonsuppressor strain) were grown in 6 L TB medium at 37° C. and induced by IPTG when cells reached log-growing phase. Periplasmic expression of the His-tagged and EPEA-tagged $Mb_{Nb207}{}^{cHopQ}$ was continued overnight at 28° C. Cells were harvested by centrifugation and the recombinant $Mb_{Nb207}{}^{cHopQ}$ was released from the periplasm using an osmotic shock (Pardon et al., 2014). Recombinant Megabody was then separated from the protoplasts by centrifugation and recovered from the clarified supernatant on a HisTrap FF 5 mL prepacked column. The protein was next eluted from the NiNTA resin by applying 500 mM imidazole and concentrated by centrifugation using NMWL filters (Nominal Molecular Weight Limit) with a cut-off of 3 kDa. Concentrated samples were next applied on a Superdex 200 PG 16/90 size exclusion column to recover 24 mg of the recombinant Megabody as a soluble protein with an apparent molecular weight of about 60 kDa.

Figure 24:
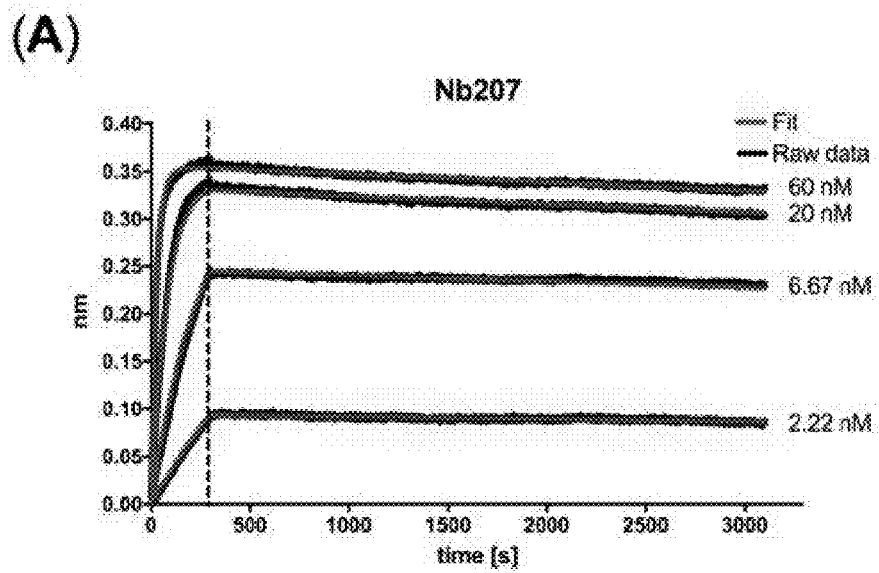

The functional properties of the purified recombinant $Mb_{Nb207}{}^{cHopQ}$ were next analysed by size exclusion chromatography (SEC). The Megabody was incubated with 4 fold-molar excess of GFP for 30 min at 4° C. and applied on a Superdex 75 PG 16/90 column. Purified GFP alone was applied on the same size exclusion column separately (FIG. 6). Elution of the different proteins was monitored by measuring the UV absorption at 280 nm (absorbed by any protein) and 488 nm (absorbed by GFP). The elution spectra shown in FIG. 6 illustrate that the mixture containing Megabody and excess GFP elutes in two symmetric peaks (blue and red absorbance profiles). The first eluting peak (highest molecular weight) absorbs at 488 nm, indicating that it contains GFP. The second peak elutes at the same elution volume of GFP alone (green absorbance profile) and also adsorbs at 488 nm. SDS-polyacrylamide electrophoreses of the corresponding elution fractions confirms that the first elution peak of the mixture containing Megabody and excess GFP contains Megabody and GFP, whereas the second peak contains GFP only. All these data indicate that the purified recombinant $Mb_{Nb207}{}^{cHopQ}$ makes a complex with GFP that resists separation by size-exclusion chromatography. Furthermore, real-time kinetic analysis of the specific binding of $Mb_{Nb207}{}^{cHopQ}$ to GFP was performed by bio-layer interferometry. Streptavidin-coated Octet® biosensors were used to capture biotinylated GFP and associated with $Mb_{Nb207}{}^{cHopQ}$ at different concentrations. The data as shown in FIG. 24 demonstrate that the affinity for GFP using the $Mb_{Nb207}{}^{cHopQ}$ was similar to the affinity when using the $Nb_{GFP}207$ alone (FIG. 24B).

Example 3. Structure Determination of a 58 kD Antigen-Binding Chimeric Protein Built from a cHopQ Scaffold Inserted into the First β-Strand AB-Connecting β-Turn of a GFP-Specific Nanobody by X-Ray Crystallography As we were able to express and purify the 58 kDa chimer $Mb_{Nb207}{}^{cHopQ}$ described in Examples 1 and 2, we set out to crystallize this Megabody and solve its structure by X-ray crystallography.

$Mb_{Nb207}{}^{cHopQ}$ was purified by SEC (FIG. 6) as complex as described in Example 2, concentrated to 48 mg/mL and subjected to a number of commercial sparse-matrix crystallization screens (JSCG/Proplex/PEGion/Wizard12/Morpheus) in 0.1 μL lying drops, supplemented with 0.1 uL of the mother liquor. Small crystals obtained in the JSCG screen A2 condition (0.1 M sodium citrate, pH 5.5, 20% w/v PEG3000) were used in the seeding optimization approach. Well-diffracting crystals were obtained in 0.2 M ammonium citrate, 17% PEG3350, 10% Glycerol 48 mg/mL Mb207, seeded from JSCG A2 crystal. Data were collected at the I3 source of Diamond (UK) and the structure was refined to 2.6 Å resolution (Table 1).

TABLE 1

Crystallization, Data Collection and Refinement Statistics

| Data statistics | |
| --- | --- |
| X-ray source | Diamond (I03) |
| Wavelength (Å) | 0.976230 |
| Space group | P1 |
| Unit Cell parameters (Å, °) | a = 71.84 b = 92.92 c = 245.41 |
| | α = 91.76 β = 97.12 γ = 112.58 |
| Resolution range (Å) | 29.44-2.62 (2.78-2.62) |
| Observed reflections | 572599 (91662) |
| Unique reflections | 321638 (51292) |
| Completeness (%) | 92.4 (91.6) |
| Rmerge (I) | 0.04 (0.61) |
| Redundancy | 1.78 (1.78) |
| Mean I/σ(I) | 9.63 (1.05) |
| Refinement statistics | |
| Rwork/Rfree [a] | 0.2651/0.3329 |
| No of protein atoms | 32769 |
| No of water | 26 |
| B factor (Å$^2$) | 107.68 |
| Rmsd bond (Å) | 0.011 |
| Rmsd angle (°) | 1.433 |
| Ramachandran favoured/outlier (%) | 81.98/4.83 |

Values for the highest-resolution shell are given in parentheses.
[a] 5% of the reflections are used for the Rfree calculation.

The Megabody crystallized in P1 with 10 molecules per asymmetric unit. The RMSD between the different molecules in the asymmetric unit range from 0.3 to 2.7 Å4, indicating that the Nanobodies are rigidly linked to the scaffold via two peptide bonds that connect Nanobody to scaffold (FIG. 7).

Example 4: Expression and Purification of a 58 kD Antigen-Binding Chimeric Protein Built from a cHopQ Scaffold Inserted into the First β-Strand AB-Connecting β-Turn of a Protein Complex Stabilizing Nanobody As a second antigen-binding chimeric protein example, we set out to express and purify 58 kD antigen-binding chimeric proteins built from the cHopQ scaffold inserted into the first β-turn connecting β-strands A and B of Nb35 that binds at the interface of the Gβ and Gα subunits of the β2 adrenergic receptor-Gs protein complex (Rasmussen et al, 2011a).

The 58 kDa Megabody called $Mb_{Nb35}{}^{cHopQ}$ is a chimeric polypeptide concatenated from parts of single-domain immunoglobulin and parts of a scaffold protein connected according to FIGS. 2 and 3. Here, the immunoglobulin domain used is a Nanobody that binds at the interface of the Gβ and Gα subunits of the β2 adrenergic receptor-Gs protein complex (Rasmussen et al, 2011 a), with the CDR1 interacting primarily with Gβ and a long CDR3 loop interacting with both Gβ and Gα subunits as depicted in SEQ ID NO:24. All parts were connected to each other from the amino to the carboxy terminus in the next given order by peptide bonds (SEQ ID NO:25): β-strand A of the anti-GFP-Nanobody (1-13 of SEQ ID NO:1), a C-terminal part of HopQ (residues 192-414 of SEQ ID NO:19), a short peptide linker (SEQ ID NO:21) connecting the C-terminus and the N-terminus of HopQ to produce a circular permutant of the scaffold protein, an N-terminal part of HopQ (residues 14-186 of SEQ ID NO:19), strands B to G of the Nanobody (residues 16-128 of SEQ ID NO:24), 6×His/EPEA tag.

In order to express $Mb_{Nb35}^{cHopQ}$ in the periplasm of *E. coli* and purify this recombinant protein to homogeneity, a DNA fragment encoding Nb35 from β-strand B to G was amplified by PCR (with primers SEQ ID NO:122 and SEQ ID NO:123) and cloned as a Sapl fragment in pMESD2 vector that directs the expression of His-tagged and EPEA-tagged cHopQNb35 Megabody (SEQ ID NO:25) in the periplasm of *E. coli* under the transcriptional control of the PLac promotor.

The $Mb_{Nb35}^{cHopQ}$ was also expressed in and purified to homogeneity from the periplasm of *E. coli* as described in example 2. Moreover, purified cHopQNb35 selectively binds at the interface of the Gβ and Gα subunits of the β2 adrenergic receptor-Gs protein complex.

Example 5: Expression and Purification of a 58 kD Antigen-Binding Chimeric Protein Built from a cHopQ Scaffold Inserted into the First β-Strand AB-Connecting β-Turn of a GPCR-Specific Nanobody As a further example, we set out to express and purify another 58 kD antigen-binding chimeric protein built from cHopQ inserted into the first β-turn connecting β-strands A and B of Nb80 that binds to the human P2 adrenergic receptor and exhibits G protein-like behaviour (Rasmussen et al, 2011b). Alternatives to such Nanobodies have been described in for instance WO2012/007593 (see Table 1,2), WO2012/175643 (see Table 2, 3), WO2014/122183 (see Table 1 and 2), and WO2015/110449 (see Table 2 and 3). The invention therefore also includes all antigen-binding chimeric proteins designed and produced as described herein, based on the sequence of said Nbs listed in these cited patent applications (listed in said Tables). Alternatively, the CDRs of said Nbs are sufficient to obtain specific stabilization of the targeted GPCR complex protein as described, and the invention therefore also includes the antigen-binding chimeric proteins designed and produced as described herein, wherein the CDRs from said cited GPCR-complex specific Nbs are the basis of the CDRs of the antigen-binding domain of said GPCR-complex binding antigen-binding chimeric proteins.

The 58 kDa Megabody called $Mb_{Nb80}^{cHopQ}$ is a chimeric polypeptide concatenated from parts of single-domain immunoglobulin and parts of a scaffold protein connected according to FIGS. 2 and 3. Here, the immunoglobulin domain used is Nb80 (SEQ ID NO:26), a Nanobody that binds at the cytoplasmic side of the β32 adrenergic receptor. An eight-amino-acid sequence of its CDR3 penetrates into a hydrophobic pocket formed by amino acids from TM segments 3, 5, 6 and 7 of the receptor. A four-amino-acid sequence of its CDR1 provides additional stabilizing interactions with cytoplasmic ends of TM segments and 6 (Rasmussen et al, 2011 b). Its CDR3 occupies a position similar to the carboxyl-terminal peptide of Gs in the β2AR-Gs protein complex (Rasmussen et al, 2011 a). All parts were connected to each other from the amino to the carboxy terminus in the next given order by peptide bonds (SEQ ID NO:27): β-strand A of the anti-GFP-Nanobody (1-13 of SEQ ID NO:1), a C-terminal part of HopQ (residues 192-414 of SEQ ID NO:19), a short peptide linker (SEQ ID NO:21) connecting the C-terminus and the N-terminus of HopQ to produce a circular permutant of the scaffold protein, an N-terminal part of HopQ (residues 14-186 of SEQ ID NO:19, β-strands B to G of Nb80 (residues 16-120 of SEQ ID NO:27), 6×His/EPEA tag. In order to express $Mb_{Nb80}^{cHopQ}$ in the periplasm of *E. coli* and purify this recombinant protein to homogeneity, a DNA fragment encoding Nb80 from β-strand B to G was amplified by PCR (with primers SEQ ID NO:122 and SEQ ID NO:123) and cloned as a Sapl fragment in pMESD2 vector as described under Example 4. This plasmid directs the expression of His-tagged and EPEA-tagged $Mb_{Nb80}^{cHopQ}$ (SEQ ID NO:27) in the periplasm of *E. coli* under the transcriptional control of the Plac promotor.

Similar to the Megabodies of previous examples, $Mb_{Nb80}^{cHopQ}$ can also be expressed in and purified to homogeneity from the periplasm of *E. coli* as described in Example 2. Moreover, purified $Mb_{Nb80}^{cHopQ}$ selectively binds and stabilizes the active state conformation of β2AR. Similar to examples described in WO2012/007593, we compared the pharmacological properties of the β2AR-wild type (wt) receptor in the presence of Nb80 or $Mb_{Nb80}^{cHopQ}$ with the properties of the β2AR-wt alone and with the properties of the β2AR-wt in the presence of an irrelevant Megabody $Mb_{Nb207}^{cHopQ}$ (FIG. 53). Nb80 is a Nanobody that selectively binds to agonist bound β2AR and exhibits G protein-like behaviour, thus stabilizing the active-state conformation of the receptor in the agonist·β2AR·Nb 80 complex (Rasmussen et al., 2011). We investigated whether the properties of Nb80 to bind to the human β2 adrenergic receptor and to exhibit G protein-like behaviour (Rasmussen et al, 2011 b) are retained in $Mb_{Nb80}^{cHopQ}$ via a Radio-ligand assay. $Nb_{GFP}207$, a Nanobody that specifically binds to GFP and has no affinity for β2AR. likewise, $Mb_{Nb207}^{cHopQ}$, were used as negative controls, and showed no affinity for β2AR (FIG. 53).

To be able to compare pharmacological effects of Nb80 or $Mb_{Nb80}^{cHopQ}$ on the β2AR, we performed a radioligand assay as follows. To express the β2AR wild type (wt) receptor, 1 µg of the pFastBac1-β2ARwt construct was transformed into the DH10Bac™ cells using the Bac-to-Bac® Baculovirus Expression system according to the manufacturer's instructions (Invitrogen, cat. Nr. 10359-016) and plated on a fresh LB agar plate supplemented with 50 µg/ml kanamycin, 7 µg/ml gentamicin, 10 µg/ml tetracycline, 100 µg/ml X-gal and 40 µg/ml IPTG. White colonies were picked, the bacmid was purified and the sequence of the open reading frame was confirmed by sequencing. Recombinant baculoviruses were produced by transfection of 2 µg bacmid DNA into Sf9 cells in a 6-well plate format together with 8 µl of Cellfectin as the transfection reagent. The cells were incubated at 27° C. and P1 viruses were collected after 3 days. Viruses were subsequently amplified by serial passaging and P3 viruses were collected. Sf9 cells at concentration of 2-3×10⁶ cells/ml were infected with baculoviruses at an M.O.I. of 0.5 and cells were expressing the receptor at 27° C. for 72 hours. Expression and cell surface localization of the receptor was assessed via Flow Cytometry using a mouse anti-FLAG M2 antibody as primary (1:100) which recognizes the FLAG peptide sequence at the N-terminal extracellular part of the receptor, and an anti-mouse DyLight405 as secondary antibody (1:100). Membranes were prepared from these cells by spinning down the cells at 1000×g for 30 minutes and by resuspending the resulting pellet in TME binding buffer (75 mM Tris/HCl pH7.4, 12.5 mM MgCl2, 1 mM EDTA) supplemented with protease inhibitors (cOmplete™ EDTA-free protease inhibitor cocktail tablets, Roche). The cells were lysed by six 10-seconds bursts using the Ultra turrax homogenizer at maximum speed. The lysates containing the membranes were then centrifuged at 40.000×g for 40 minutes at 4° C., the supernatant was discarded, and the membrane pellet was resuspended in TME binding buffer supplemented with 10% saccharose. The membranes were stored at −80° C. until further use. The total membrane protein content was estimated using a Pierce BCA Protein Assay Kit (Thermo Scientific) following the manufacturer's instructions. In order to normalize the data according to the total membrane protein concentration for further analysis, all samples were diluted to a final concentration of 0.2 mg/ml. For the radioligand competition binding assays, 10 µg of membranes expressing β2AR-wt were incubated with increasing concentrations of either epinephrine (natural agonist, Sigma cat. Nr E4250) or (−)-isoproterenol hydrochloride (full agonist, Sigma cat. Nr 16504) ranging from $10^{-11}$ M to $10^4$ M in presence of 2 nM [$^3$H]-dihydroalprenolol and in the presence of 5 µM Nb80, $Mb_{Nb80}{}^{cHopQ}$, $Mb_{Nb207}{}^{cHopQ}$, or no nanobody. Non-specific binding was determined in presence of 10 µM alprenolol. Samples were incubated for 2 hours at room temperature on a shaking platform, and receptor-bound radioligand was separated from free radioligand by filtration over Whatman GF/C unifilters (Perkin Elmer, cat nr 6005174) using a 96-well FilterMate harvester (Perkin Elmer). After filtration, membranes retained on the filter plates were washed with ice-cold wash buffer (20 mM Tris-HCl pH7.4), and filters were dried for 1 hour at 50° C. After adding 35 µl of scintillation fluid (MicroScint™-O, Perkin Elmer), radioactivity (cpm) retained on the filters was measured in a Wallac MicroBeta TriLux scintillation counter. Data represent the mean±s.e. of each experiment performed in duplicate. The IC50 values were determined by nonlinear regression analysis using Prism (GraphPad Software, San Diego, CA).

As shown in FIG. 53, we found that the pharmacological properties of the β2AR-wt in the presence of $Mb_{Nb80}{}^{cHopQ}$ are very similar to the pharmacological properties of the β2AR-wt in the presence of Nb80 and profoundly different from the properties of β2AR-wt alone or β2AR-wt in the presence of $Mb_{Nb207}{}^{cHopQ}$ Compared to the β2AR-wt alone, the β2AR-wt receptor in the presence of $Mb_{Nb80}{}^{cHopQ}$ with G protein-like behaviour (cfr Nb80) exhibits increased affinities for agonists (epinephrine, isoproterenol), showing that the receptor in the presence of $Mb_{Nb80}{}^{cHopQ}$ adopts an active-state conformation (Rasmussen et al, 2011 b). The increased affinity of the β2AR-wt in the presence of $Mb_{Nb80}{}^{cHopQ}$, compared to control β2AR-wt for the natural agonist epinephrine can be calculated from the ratio of the IC50 values from the competitive binding experiments depicted in FIG. 53 (A) by dividing the IC50 of epinephrine for β2AR-wt alone by the $IC50^{high}$ of epinephrine for β2AR-wt in the presence of $Mb_{Nb80}{}^{cHopQ}$, resulting in an apparent potency shift of ~ 2000. The increased affinity of β2AR-wt in the presence of $Mb_{Nb80}{}^{cHOPQ}$ for the synthetic agonist isoproterenol can be calculated from the ratio of the IC50 values from the competitive binding experiments depicted in FIG. 53 (B) by dividing the IC50 of isoproterenol for β2AR-wt by the $IC50^{high}$ of isoproterenol for β2AR-wt in the presence of $Mb_{Nb80}{}^{cHopQ}$, resulting in an apparent potency shift of ≈ 2000. In conclusion, we demonstrated that the functionality of Nb80 has been retained in the $Mb_{Nb80}{}^{cHopQ}$ format, moreover, that due to its retained antigen-binding affinity for the β2AR target, in fact it stabilizes the β2AR active-state conformation, and likewise to Nb80 provides conformation selective antigen binding.

Example 6: Expression and Purification of a 58 kD Antigen-Binding Chimeric Protein Built from a cHopQ Scaffold Inserted into the First β-Strand AB-Connecting β-Turn of an Ion-Channel-Binding Nanobody As a further example, we set out to express and purify another 58 kD antigen-binding chimeric protein built from cHopQ inserted into the first β-turn connecting β-strands A and B of Nb25 that binds the pentameric ligand-gated ion channel GABA$_A$ (Miller et al, 2017).

The 58 kDa Megabody called $Mb_{Nb25}{}^{cHopQ}$ is a chimeric polypeptide concatenated from parts of single-domain immunoglobulin and parts of a scaffold protein connected according to FIGS. 2 and 3. Here, the immunoglobulin domain used is Nb25 (SEQ ID NO:28), a Nanobody that binds to the extracellular domain of the GABAA β33 subunit (Miller et al, 2017). All parts were connected to each other from the amino to the carboxy terminus in the next given order by peptide bonds (SEQ ID NO:29): β-strand A of the anti-GFP-Nanobody (1-13 of SEQ ID NO:1), a C-terminal part of HopQ (residues 192-414 of SEQ ID NO:19), a short peptide linker (SEQ ID NO:21) connecting the C-terminus and the N-terminus of HopQ to produce a circular permutant of the scaffold protein, an N-terminal part of HopQ (residues 14-186 of SEQ ID NO:19), β-strands B to G of Nb25 (residues 16-125 of SEQ ID NO:28), 6×His/EPEA tag.

In order to express $Mb_{Nb25}{}^{cHopQ}$ in the periplasm of E. coli and purify this recombinant protein to homogeneity, a DNA fragment encoding Nb25 from β-strand B to G was amplified by PCR (with primers SEQ ID NO:122 and SEQ ID NO:123) and cloned as a Sapl fragment in pMESD2 vector as described under Example 4. This plasmid directs the expression of His-tagged and EPEA-tagged $Mb_{Nb25}{}^{cHopQ}$ (SEQ ID NO:29) in the periplasm of E. coli under the transcriptional control of the Plac promotor.

Similar to the Megabodies of previous examples, $Mb_{Nb25}{}^{cHopQ}$ can also be expressed in and purified to homogeneity from the periplasm of E. coli as described in example 2. Moreover, purified $Mb_{Nb25}{}^{cHopQ}$ binds to the extracellular domain of the GABAA 133 subunit.

Example 7. Design and Generation of Other 58 kD Antigen-Binding Chimeric Proteins Built from cHopQ Inserted into the First β-Strand AB-Connecting β-Turn of a GFP-Specific Nanobody by In Vitro Selection As the capacity to fold, but also the stability and the rigidity of Megabodies may rely on the composition and the length of the polypeptide linkages that connect the immunoglobulin to the scaffold, we introduced in vitro evolution techniques for the fine-tuning of particular Megabody formats if required. Starting from the Megabody described in Example 1, we constructed libraries encoding Megabodies with a similar design in which two short peptides of variable length and mixed amino acid composition connect Nanobody to scaffold according to FIG. 2 that are amenable to in vitro selection.

The 58 kDa Megabodies described here are chimeric polypeptides concatenated from parts of a single-domain immunoglobulin and parts of a scaffold protein connected by short polypeptide linkages according to FIG. 2. Here, the immunoglobulin used is a GFP-binding Nanobody as depicted in SEQ ID NO:1. All parts were connected to each other from the amino to the carboxy terminus in the next given order by peptide bonds (SEQ ID NO:30-33): β-strand A of the anti-GFP-Nanobody (1-12 of SEQ ID NO:1), a peptide linker of one or two amino acids with random composition, a C-terminal part of HopQ (residues 193-414 of SEQ ID NO:19), a peptide linker (SEQ ID NO:21) connecting the C-terminus and the N-terminus of HopQ to produce a circular permutant of the scaffold protein, an N-terminal part of HopQ (residues 15-186 of SEQ ID NO:19), a peptide linker of one or two amino acids with random composition, β-strands B to G of the anti-GFP-Nanobody (residues 11-126 of SEQ ID NO:1), 6×His tag and EPEA tag.

To display and select functional variants of the Megabody described in Examples 1, 2 & 3 that differ in composition and length of the linkers connecting Nanobody to scaffold on yeast, we used standard methods to construct a library of open reading frame that encode the various Megabodies in fusion to a number of accessory peptides and proteins (SEQ ID NO:34-37) according to FIG. 8: the appS4 leader sequence that directs extracellular secretion in yeast (Rakestraw, 2009), β-strand A of the anti-GFP-Nanobody (1-12 of SEQ ID NO:1), a peptide linker of one or two amino acids with random composition, a C-terminal part of HopQ (residues 193-414 of SEQ ID NO:19), a short peptide linker (SEQ ID NO:21) connecting the C-terminus and the N-terminus of HopQ to produce a circular permutant of the scaffold protein, an N-terminal part of HopQ (residues 15-186 of SEQ ID NO:19), a peptide linker of one or two amino acids with random composition, β-strands B to G of the anti-GFP-Nanobody (residues 11-126 of SEQ ID NO:1), a flexible $(GGSG)_n$ peptide linker, the Aga2p adhesion subunit of the yeast agglutinin protein Aga2p which attaches to the yeast cell wall through disulfide bonds to Aga1p protein, followed by an acyl carrier protein for the orthogonal fluorescent staining of the displayed fusion protein (Johnsson, 2005) and the myctag. These open reading frames were put under the transcriptional control of galactose-inducible GAL1/10 promotor into the pCTCON2 vector (Chao, 2006) to construct a yeast display library encoding 184.000 different variants of the Megabody described in Examples 1, 2 and 3 (See FIG. 8). For in vitro selection, this library was introduced into yeast strain EBY100. Transformed cells were grown and induced overnight in a galactose-rich medium. Induced cells were orthogonally stained with coA-647 (2 μM) using the SFP synthase (1 μM) and incubated with 100 nM of GFP. Next, these cells were washed and subjected to 2-parameter FACS analysis to identify yeast cells that display high levels of a particular Megabody (high CoA-647 fluorescence) and bind the antigen GFP (high GFP fluorescence). Cells that display high levels of a GFP binding Nanobody were sorted and amplified in a glucose-rich medium to be subjected to following rounds of selection by yeast display and two-parameter FACS analysis.

Figure 30:
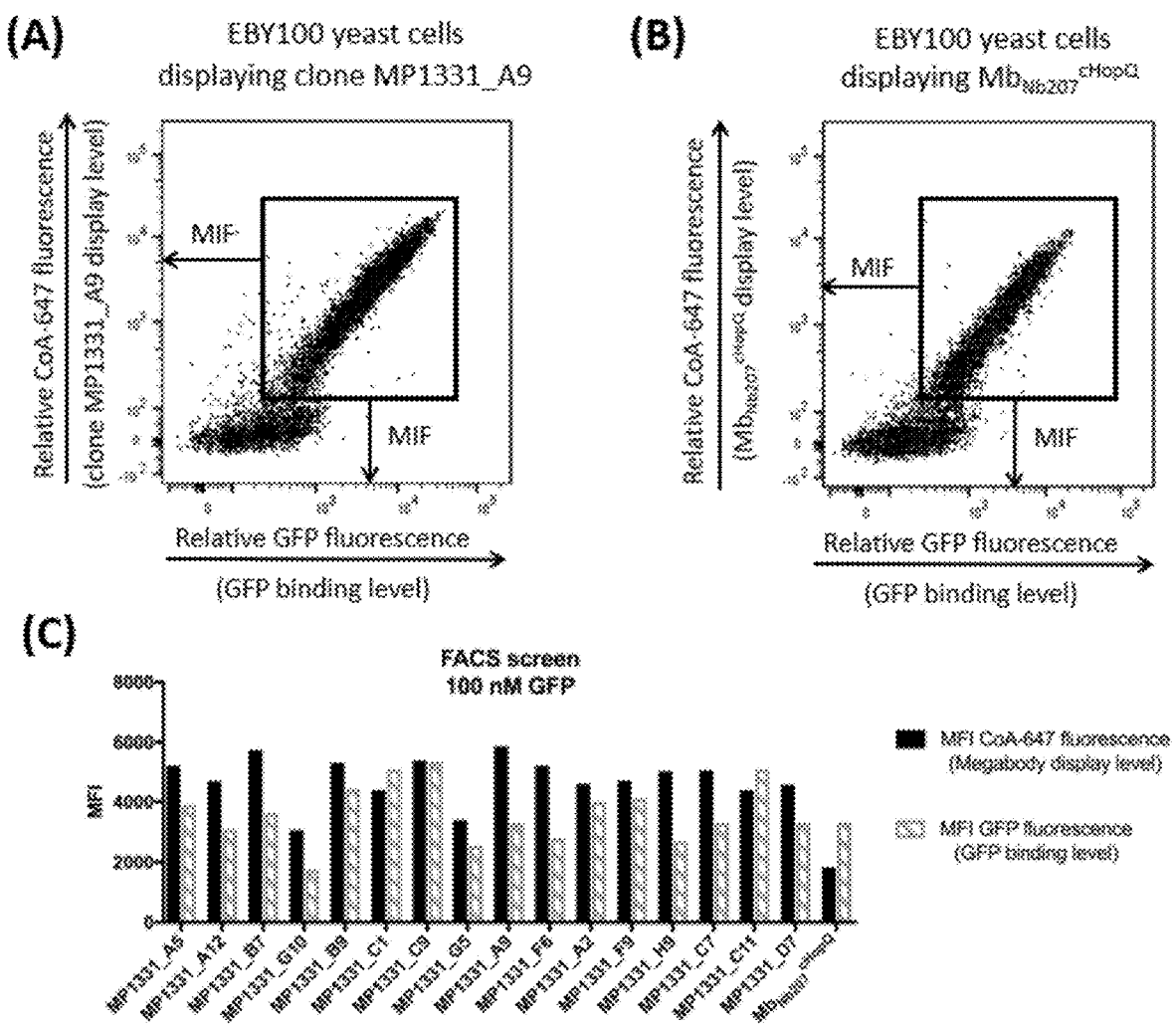

After one round of selection, a representative number of highly fluorescent cells in the CoA-647 and GFP channels were grown as single colonies and subjected to DNA sequencing to determine the sequences of a representative number of peptide linkers connecting Nanobody to scaffold protein. Four representative clones of each type of linkers with 1-1, 1-2, 2-1 and 2-2 amino acid short linker variants (Table 2) were confirmed to bind to 100 nM GFP in FACS experiments (FIG. 30). This demonstrates that different short peptide connections between antigen-binding domain and scaffold protein can be selected from Megabody libraries by in vitro selections and displayed as functional antigen-binding chimeric proteins. As we were able to display the functional variants of Megabody on the surface of yeast (above), we set out to express the four 1-1 amino acid short linkers representative Megabody clones (MP1331_A5, MP1331_A12, MP1331_B7 and MP1331_G10 from Table 2) in the periplasm of E. coli, purified these chimer to homogeneity and determined its properties. The four variants of Megabody $Mb_{Nb207}^{c7HopQ}$ ($Mb_{Nb207}^{c7HopQ}$ A5, $Mb_{Nb207}^{c7HopQ}$ A12, $Mb_{Nb207}^{c7HopQ}$ B7, $Mb_{Nb207}^{c7HopQ}$ G10) and wild type with short (c7; see Example 23) circular permutation ($Mb_{Nb207}^{c7HopQ}$), were essentially generated as described in Example 2:$Mb_{Nb207}^{cHopQ}$ (SEQ ID NO:136): β-strand A of the conserved N-terminus of the anti-GFP-Nanobody (1-13 of SEQ ID NO:1), a C-terminal part of HopQ (residues 192-411 of SEQ ID NO:19), an N-terminal part of HopQ (residues 18-186 of SEQ ID NO:19), β-strands B to G of the anti-GFP-Nanobody (residues 16-126 of SEQ ID NO:1), 6×His tag and EPEA tag.

The four $Mb_{Nb207}^{cHopQ}$ variants (SEQ ID NO:137-140): β-strand A of the conserved N-terminus of the anti-GFP-Nanobody (1-12 of SEQ ID NO:1), one amino acid linker (Table 2), a C-terminal part of HopQ (residues 193-411 of SEQ ID NO:19), an N-terminal part of HopQ (residues 18-185 of SEQ ID NO:19), one amino acid linker (Table 2), β-strands B to G of the anti-GFP-Nanobody (residues 17-126 of SEQ ID NO:1), 6×His/EPEA tag.

Figure 31:
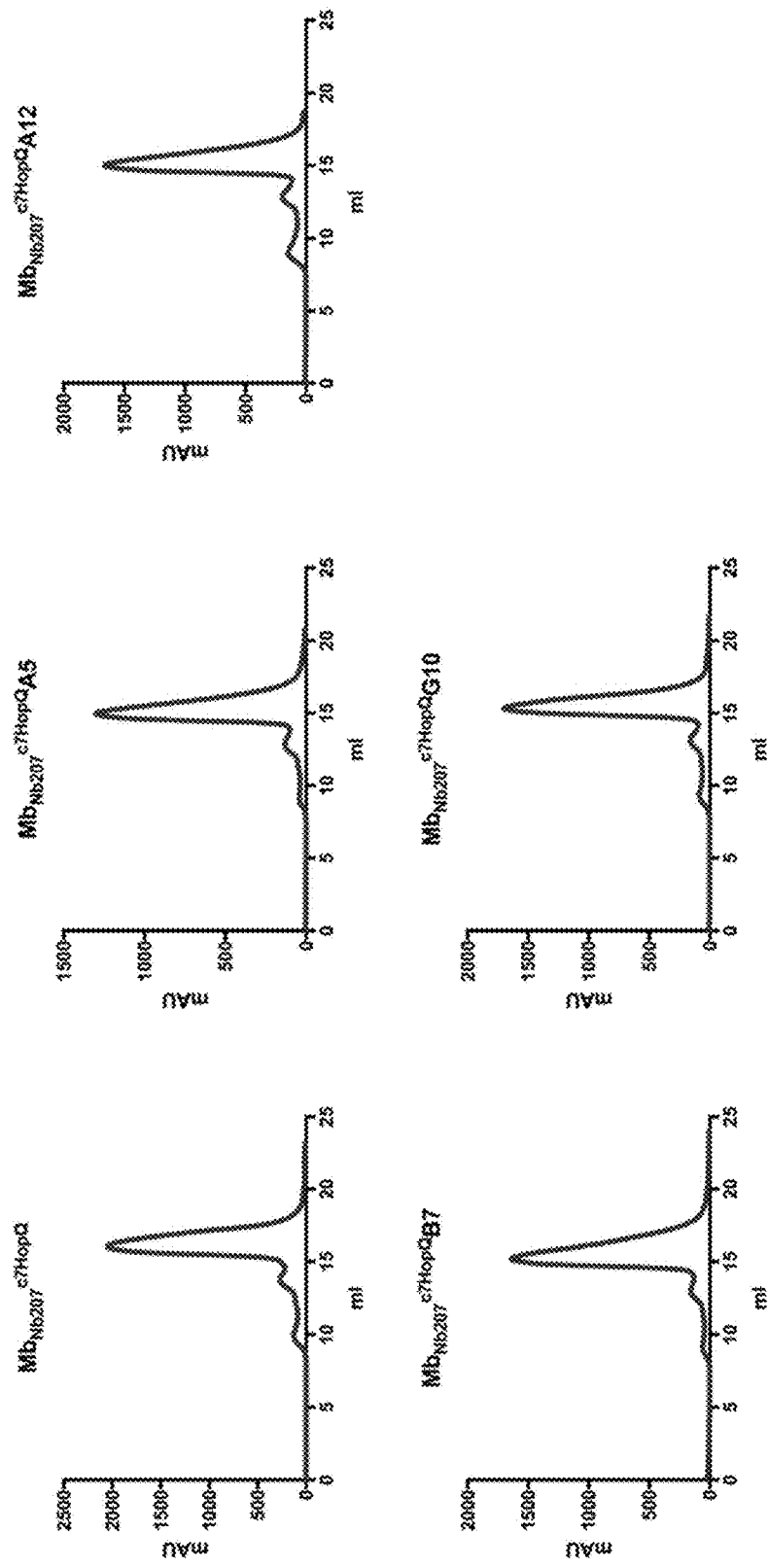
Figure 32:
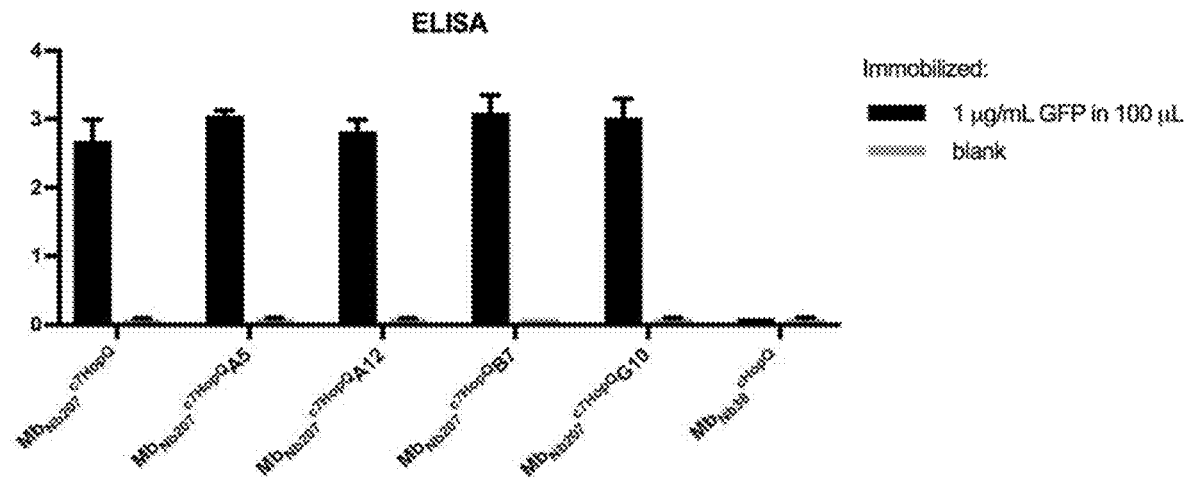

These Megabodies (SEQ ID NO:136-140) were expressed in E. coli and purified as described in Example 2. Concentrated samples were next applied on a Superdex 200 PG 10/300 size exclusion column and eluted as homogenous, soluble protein samples with an apparent molecular weight of about 60 kDa (FIG. 31). The functional properties of the purified recombinant Megabodies (SEQ ID NO:136-140) were analysed by enzyme-linked immunosorbent assay (ELISA). Purified GFP was immobilized in the wells of a maxisorp microtitre plate (Nunc) at a concentration of 0,1 μg/well in sodium bicarbonate buffer pH 8.2. Residual protein binding sites in the wells were blocked for two hours at room temperature with milk in PBS. Purified Megabody samples were incubated on GFP coated and on non-coated wells. After washing steps, the binding of Megabodies to GFP was examined by using the CaptureSelect biotinylated antibody (Life Technologies) that specifically recognizes the EPEA-tag, present only on the Megabody. Subsequent detection of Capture Select biotinylated antibody was done with Streptavidin-Alkaline phosphatase (Promega). The absorption at 405 nm was measured after adding the enzyme substrate p-nitrophenyl phosphate. Detected signals show at least 10-fold higher signals of each Megabody comparing a condition with immobilized GFP to no GFP. The ELISA and SEC data indicate that the purified recombinant Megabodies (SEQ ID NO:136-140) can be purified to homogeneity and form complex with GFP (FIGS. 31 and 32).

TABLE 2

The composition and length of the yeast-display optimized linker peptides connecting scaffold protein HopQ Nanobody

| Megabody clone | Connection #1 | Connection #2 |
|---|---|---|
| MP1331_A5 | A | M |
| MP1331_A12 | R | P |
| MP1331_B7 | Y | R |
| MP1331_G10 | L | S |
| MP1331_B9 | V | NT |
| MP1331_C1 | R | GP |
| MP1331_C9 | P | PA |

TABLE 2-continued

The composition and length of the yeast-display optimized linker peptides connecting scaffold protein HopQ Nanobody

| Megabody clone | Connection #1 | Connection #2 |
|---|---|---|
| MP1331_G5 | R | PR |
| MP1331_A9 | VW | R |
| MP1331_F6 | TW | S |
| MP1331_A2 | HD | S |
| MP1331_F9 | GG | M |
| MP1331_H9 | FL | HQ |
| MP1331_C7 | FV | QP |
| MP1331_C11 | YR | PT |
| MP1331_D7 | GS | KQ |

Example 8: Design and Generation of α100 kDa Antigen-Binding Chimeric Protein Built from a cYgjK Inserted into the First Exposed β-Turn (Connecting β-Strands A and B) of a GFP-Specific Nanobody by In Vitro Selection Alternatively, a Megabody was designed built from Nanobodies connected to larger scaffolds. Libraries encoding Megabody variants in which two short peptides connect the Nanobody to another scaffold according to FIGS. 2 and 9 were constructed for in vitro selection.

The designed 100 kDa Megabodies are chimeric polypeptides concatenated from parts of a single-domain immunoglobulin and parts of a scaffold protein linked by short polypeptide linkers according to FIG. 2. The immunoglobulin used is a GFP-binding Nanobody as depicted in SEQ ID NO:1. The alternative scaffold protein used was YgjK, a 86 kDA periplasmic protein of E. coli (PDB 3W7S, SEQ ID NO: 38). All parts were connected to each other from the amino to the carboxy terminus in the next given order by peptide bonds (SEQ ID NO:39-42): β-strand A of the anti-GFP-Nanobody (residues 1-12 of SEQ ID NO:1), a peptide linker of one or two amino acids with random composition, the C-terminal part of YgjK (residues 464-760 of SEQ ID NO:38), a short peptide linker (SEQ ID NO:43) connecting the C-terminus and the N-terminus of YgjK to produce a circular permutant of the scaffold protein, the N-terminal part of YgjK (residues 1-461 of SEQ ID NO:38), a peptide linker of one or two amino acids with random composition, β-strands B to G of the anti-GFP-Nanobody (residues 17-126 of SEQ ID NO:1).

To display and select functional variants of $Mb_{Nb207}{}^{cYgjkQ}$ randomlinkers (SEQ ID NO:39-42) that differ in composition and length of the linkers connecting Nanobody to scaffold on yeast, we used standard methods to construct a library of open reading frame that encode the various Megabodies in fusion to a number of accessory peptides and proteins (SEQ ID NO:44-47): the appS4 leader sequence that directs extracellular secretion in yeast (Rakestraw, 2009), β-strand A of the anti-GFP-Nanobody (1-12 of SEQ ID NO:1), a peptide linker of one or two amino acids with random composition, C-terminal part of YgjK (residues 464-760 of SEQ ID NO:38), a short peptide linker (SEQ ID NO:43) connecting the C-terminus and the N-terminus of YgjK to produce a circular permutant of the scaffold protein, an N-terminal part of YgjK (residues 1-461 of SEQ ID NO:38), a peptide linker of one or two amino acids with random composition, β-strands B to G of the anti-GFP-Nanobody (residues 17-126 of SEQ ID NO:1), a flexible (GGSG)$_n$ peptide linker, the Aga2p adhesion subunit of the yeast agglutinin protein Aga2p which attaches to the yeast cell wall through disulfide bonds to Aga1p protein, followed by an acyl carrier protein for the orthogonal fluorescent staining of the displayed fusion protein (Johnsson, 2005) and the myc tag. These open reading frames were put under the transcriptional control of galactose-inducible GAL1/10 promotor into the pCTCON2 vector (Chao, 2006) to construct a yeast display library encoding 184.000 different variants of $Mb_{Nb207}{}^{cYgjkQ}$ randomlinkers (SEQ ID NO:39-42).

For in vitro selection, this library was introduced into yeast strain EBY100. Transformed cells were grown and induced overnight in a galactose-rich medium. Induced cells were orthogonally stained with coA-647 (2 μM) using the SFP synthase (1 μM) and incubated with 100 nM of GFP. Next, these cells were washed and subjected to 2-parameter FACS analysis to identify yeast cells that display high levels of a particular Megabody (high CoA-647 fluorescence) and bind the antigen GFP (high GFP fluorescence). Cells that display high levels of a GFP binding Nanobody were sorted and amplified in a glucose-rich medium to be subjected to following rounds of selection by yeast display and two-parameter FACS analysis.

After two rounds of selection, a representative number of highly fluorescent cells in the CoA-647 and GFP channels were grown as single colonies and subjected to DNA sequencing to determine the sequences of a representative number of peptide linkers connecting Nanobody to scaffold protein. One or two representative clones of each linker type (length) 1-1, 1-2, 2-1 and 2-2 amino acid short linker variants (Table 3) were confirmed to bind to 100 nM GFP in FACS experiments (FIG. 33). This demonstrates that different short peptide connections between antigen-binding domain and scaffold protein can be selected from Megabody libraries by in vitro selections and displayed as functional antigen-binding chimeric proteins. As we were able to display the functional variants of $Mb_{Nb207}{}^{cYgjkQ}$ on the surface of yeast (above), we set out to express one clone of each amino-acid short linkers representative Megabody clones (MP1333_E2, MP1333_A2, MP1333_C4 and MP1333_F5 from Table 3) in the periplasm of E. coli. Four variants of $Mb_{Nb207}{}^{cYgjkQ}$, selected by yeast display were generated as chimeric polypeptides with following amino acid sequences: $Mb_{Nb207}{}^{cYgjk}E2$ (SEQ ID NO:141): β-strand A of the anti-GFP-Nanobody (1-12 of SEQ ID NO:1), Tyr one amino acid linker, C-terminal part of YgjK (residues 464-760 of SEQ ID NO:38), a short peptide linker (SEQ ID NO:43) connecting the C-terminus and the N-terminus of YgjK to produce a circular permutant of the scaffold protein, an N-terminal part of YgjK (residues 1-461 of SEQ ID NO:38), Asp one amino acid linker, β-strands B to G of the anti-GFP-Nanobody (residues 17-126 of SEQ ID NO:1), 6×His/EPEA tag.

Similar constructs were obtained for the other Megabodies, with the difference found in the linker identity: $Mb_{Nb207}{}^{cYgjk}A2$ (SEQ ID NO:142): Glu 1-amino acid linker, Gly-Asp 2-amino acids linker; $Mb_{Nb207}{}^{cYgjk}C4$ (SEQ ID NO:143): Met-Tyr2-amino acids linker, Asn 1-amino acid linker, $Mb_{Nb207}{}^{cYgjk}F5$ (SEQ ID NO:144): Trp-Thr 2-amino acids linker, Gly-Ala 2-amino acids linker.

The $Mb_{Nb207}{}^{cYgjk}$ variants (SEQ ID NO: 141-144) were expressed in E. coli, as described in Example 2, applying a modified pMESD2 vector. This new vector (called pMESP3) contains an open reading frame that encodes the following polypeptides: the pelB leader sequence that directs the secretion of the Megabody to the periplasm of E. coli, β-strand A of $Nb_{GFP}207$, a circularly permutated variant of YgjK, C-terminal part of any Nanobody (from β-strand B to β-strand G), the 6×His tag and the EPEA tag followed by the Amber stop codon.

The functional properties of the expressed Megabodies were analysed by ELISA as described in Example 7, using periplasmic extracts of each of four $Mb_{Nb207}^{cYgjk}$ variants. Comparison of detected signals for sample with and without immobilized GFP (FIG. 34) clearly confirmed the periplasmic expression of functional $Mb_{Nb207}^{cYgjk}$ variants (SEQ ID NO:141-144).

The $Mb_{Nb207}^{cYgjk}$E2 (SEQ ID NO:141) representing 1-1 amino acid short linkers variant was further purified to homogeneity using IMAC followed by SEC as described in Example 2 (FIG. 35). Binding kinetics to GFP of purified $Mb_{Nb207}^{cYgjk}$E2 (SEQ ID NO:141) was measured by Octet® and compared to $Nb_{GFP}$207 Nanobody (SEQ ID NO:1) and $Mb_{Nb207}^{cHopQ}$ (SEQ ID NO:20) (FIG. 24). Calculated binding affinities confirmed that antigen-binding chimeric proteins, built from a circularly permutated HopQ or YgjK scaffold proteins do not interfere with the binding properties of the original single-domain immunoglobulin.

TABLE 3

The composition and length of the yeast-display optimized linker peptides connecting scaffold protein YgjK to Nanobody

| Megabody clone | Connection #1 | Connection #2 |
|---|---|---|
| MP1333_E2 | Y | D |
| MP1333_E6 | LA | D |
| MP1333_C4 | MY | N |
| MP1333_A2 | E | GD |
| MP1333_D6 | F | GA |
| MP1333_F5 | WT | GA |
| MP1333_C2 | FM | PA |

Example 9: Design and Generation of 58 kDa Antigen-Binding Chimeric Proteins Built from c/cHopQ Inserted into the First β-Strand AB-Connecting β-Turn of a GFP-Specific Nanobody, Further Rigidified by an Extra Disulphide Connecting Scaffold to Nanobody We further developed even more rigid antigen-binding chimeric proteins by engineering an extra disulphide bond that connects the antigen-binding domain, here immunoglobulin domain, to the scaffold according to FIG. 10. Accordingly, we used site-directed mutagenesis to produce mutants of $Mb_{Nb207}^{cHopQ}$ in which two short peptides and a disulphide bond connect the Nanobody to the scaffold according to FIGS. 2 and 10.

The 58 kDa Megabodies described here are chimeric polypeptides concatenated from parts of a single-domain immunoglobulin and parts of a scaffold protein linked by short polypeptide linkages and a disulphide bond according to FIGS. 2 and 10. Here, the immunoglobulin used is a GFP-binding Nanobody as depicted in SEQ ID NO:1. The scaffold protein is an adhesin domain of *Helicobacter pylori* strain G27 (PDB: 5LP2, SEQ ID NO:19) called HopQ. All parts were connected to each other from the amino to the carboxy terminus in the next given order by peptide bonds (SEQ ID NO:48-50): β-strand A of the anti-GFP-Nanobody (1-13 of SEQ ID NO:1), a C-terminal part of HopQ (residues 192-414 of SEQ ID NO:19), a short peptide linker (SEQ ID NO:21) connecting the C-terminus and the N-terminus of HopQ to produce a circular permutant of the scaffold protein (cHopQ), an N-terminal part of HopQ (residues 14-186 of SEQ ID NO:19) in which one residue was replaced by cysteine, β-strands B to G of the Nanobody (residues 16-126 of SEQ ID NO:1) in which one residue was replaced by cysteine, 6×His/EPEA tag. SEQ ID NO:51 was built from β-strand A of the anti-GFP-Nanobody (1-13 of SEQ ID NO:1), a C-terminal part of HopQ (residues 192-414 of SEQ ID NO:1) in which one residue was replaced by cysteine, a short peptide linker (SEQ ID NO:21) connecting the C-terminus and the N-terminus of HopQ to produce a circular permutant of the scaffold protein (cHopQ), an N-terminal part of HopQ (residues 14-186 of SEQ ID NO:19), β-strands B to G of the Nanobody (residues 16-126 of SEQ ID NO:1) in which one residue was replaced by cysteine, 6×His/EPEA tag.

Further constructs were designed applying the shorter cHopQ circular permutant (for cHopQ: see Example 23) as scaffold protein: SEQ ID NO: 146-150 were built from β-strand A of the anti-GFP-Nanobody (1-13 of SEQ ID NO:1), a C-terminal part of HopQ (residues 192-411 of SEQ ID NO:19), an N-terminal part of HopQ (residues 18-186 of SEQ ID NO:19) in which one residue was replaced by cysteine, β-strands B to G of the Nanobody (residues 16-126 of SEQ ID NO:1) in which one residue was replaced by cysteine, 6×His tag and EPEA tag. SEQ ID NO:145 was built from β-strand A of the anti-GFP-Nanobody (1-13 of SEQ ID NO: 1), a C-terminal part of HopQ (residues 192-411 of SEQ ID NO:1) in which one residue was replaced by cysteine, an N-terminal part of HopQ (residues 18-186 of SEQ ID NO:19), β-strands B to G of the Nanobody (residues 16-126 of SEQ ID NO:1) in which one residue was replaced by cysteine, 6×His tag and EPEA.

In total 10 Megabody variants ($Mb_{Nb207}^{cHopQ}$ Cys1-4 (SEQ ID NO:48-51) and $Mb_{Nb207}^{c7HopQ}$ Cys5-10 (SEQ ID NO:145-150) were expressed and purified from *E. coli* as described in Example 2. The functional properties of these purified recombinant Megabodies were analysed by ELISA as described in Example 7. Comparison of detected signals for samples with and without immobilized GFP (FIG. 36) clearly confirmed the functionality of $Mb_{Nb207}^{cHopQ}$ Cys1-4 (SEQ ID NO:48-51) and $Mb_{Nb207}^{c7HopQ}$ Cys5-10 (SEQ ID NO:145-150), purified from periplasm of *E. coli*.

To measure the contribution of an introduced additional disulphide on the thermostability of these engineered Megabody variants we performed thermal Shift Assays (TSA) and calculated the melting temperature (Tm) of each Megabody variant as described before (Hunynh et al., 2015). Accordingly, 0.2 mg/mL of each gel-filtration purified Megabody variant was mixed with SYPRO Orange dye (Sigma) in 140 mM NaCl and 10 mM Tris pH 7.3 buffer. Next, the fluorescence of 20 μL samples was measured in triplicates by Real-Time PCR on a Bio-Rad CFX96 machine over a temperature range from 25 to 100° C. Individual Tm values were calculated by GraphPad Prism software using the Boltzmnann equation (Table 4). The melting temperatures increased by 10.9° C., 3.43° C., 4.29° C. and 6.14° C. compared to the wild-type Megabody for $Mb_{Nb207}^{cHopQ}$ $C_{15}$-$C_{534}$ (SEQ ID NO:51), $Mb_{Nb207}^{c7HopQ}$ $C_{14}$-$C_{512}$ (SEQ ID NO:145), $Mb_{Nb207}^{c7HopQ}$ $C_{316}$-$C_{472}$ (SEQ ID NO:147) and $Mb_{Nb207}^{c7HopQ}$ $C_{314}$-$C_{472}$ (SEQ ID NO:148), respectively indicating that these disulphide bonds are formed and rigidify the Megabodies.

TABLE 4

Melting temperatures (Tm) for $Mb_{Nb207}^{c/c7HopQ}$ Cysteine variants.

| Megabody clone | Tm [° C.] |
|---|---|
| $Mb_{Nb207}^{cHopQ}$ | 48.7 |
| $Mb_{Nb207}^{cHopQ}$ $C_{357}$-$C_{425}$ | 49 |

TABLE 4-continued

Melting temperatures (Tm) for $Mb_{Nb207}^{c/c7HopQ}$ Cysteine variants.

| Megabody clone | Tm [° C.] |
|---|---|
| $Mb_{Nb207}^{cHopQ} C_{358}-C_{488}$ | (43.8)* 49.5 |
| $Mb_{Nb207}^{cHopQ} C_{359}-C_{490}$ | (44.2)* 49.7 |
| $Mb_{Nb207}^{cHopQ} C_{15}-C_{534}$ | (49.4)* 59.6 |
| $Mb_{Nb207}^{c7HopQ}$ | 49.74 |
| $Mb_{Nb207}^{c7HopQ} C_{14}-C_{512}$ | 53.17 |
| $Mb_{Nb207}^{c7HopQ} C_{402}-C_{474}$ | 47.01 |
| $Mb_{Nb207}^{c7HopQ} C_{316}-C_{472}$ | 54.02 |
| $Mb_{Nb207}^{c7HopQ} C_{314}-C_{472}$ | (49.16)* 55.88 |
| $Mb_{Nb207}^{c7HopQ} C_{312}-C_{453}$ | 50.34 |
| $Mb_{Nb207}^{c7HopQ} C_{349}-C_{452}$ | 50.03 |

*First transition melting temperature (see FIG. 36)

Example 10: Design and Generation of Antigen-Binding Chimeric Proteins Built from a GFP-Specific Nanobody Grafted onto Azurin by In Vitro Selection Another manner to generate rigid antigen-binding chimeric proteins is to connect the immunoglobulins to their scaffolds via alternative linking schemes. Accordingly, libraries encoding Megabodies built from a Nanobody grafted onto a scaffold protein via three polypeptide linkages that connect Nanobody to scaffold as illustrated in FIG. 11 were constructed and are amenable to in vitro selection.

The rigid antigen-binding chimeric proteins described here are chimeric polypeptides concatenated from parts of a single-domain immunoglobulin and parts of a scaffold protein linked by three short polypeptide linkages according to FIG. 11. The immunoglobulin used is a GFP-binding Nanobody as depicted in SEQ ID NO:1. The scaffold protein used was Azurin, a small copper containing single domain protein of *Pseudomonas aeruginosa* (PDB 2TSA, SEQ ID NO: 52, a M121A mutation compared to the *P. aeruginosa* protein). All parts were connected to each other from the amino to the carboxy terminus in the next given order by peptide bonds (SEQ ID NO:53-60): β-strand A of the anti-GFP-Nanobody (1-12 of SEQ ID NO:1), a peptide linker of one or two amino acids with random composition, N-terminal part of Azurin (Residue 3-22 of SEQ ID NO:52), a peptide linker of one or two amino acids with random composition, β-strands B to G of the anti-GFP-Nanobody (residues 17-126 of SEQ ID NO:1), a peptide linker of one or two amino acids with random composition, C-terminal part of Azurin (residues 31-128 of SEQ ID NO:52), 6×His and EPEA tag.

To display and select functional representatives of these metal-binding Megabodies in which three short peptides connect the Nanobody to the scaffold (SEQ ID NO:53-60) on yeast, we used standard methods to construct a library of open reading frames that encode the various Megabodies in fusion to a number of accessory peptides and proteins (SEQ ID NO:61-68): the appS4 leader sequence that directs extracellular secretion in yeast (Rakestraw, 2009), β-strand A of the anti-GFP-Nanobody (1-12 of SEQ ID NO:1), a peptide linker of one or two amino acids with random composition, N-terminal part of Azurin (Residue 3-22 of SEQ ID NO:52), a peptide linker of one or two amino acids with random composition, strands B to G of the anti-GFP-Nanobody (residues 17-126 of SEQ ID NO:1), a peptide linker of one or two amino acids with random composition, C-terminal part of Azurin (residues 31-128 of SEQ ID NO:52), a flexible $(GGSG)_n$ peptide linker, the Aga2p adhesion subunit of the yeast agglutinin protein Aga2p which attaches to the yeast cell wall through disulphide bonds to Aga1p protein, followed by an acyl carrier protein for the orthogonal fluorescent staining of the displayed fusion protein (Johnsson, 2005) and the myctag. These open reading frames were put under control of galactose-inducible GAL1/10 promotor into the pCTCON2 vector (Chao, 2006) to construct a yeast display library encoding 77.280.000 different variants of the Megabody in which three short peptides and connect the Nanobody to Azurin according to FIG. 12.

For in vitro selection by yeast display and FACS, this library was introduced into yeast strain EBY100. Transformed cells were grown and induced overnight in a galactose-rich medium in the presence of $Cu^{++}$. Induced cells were orthogonally stained with coA-647 (2 µM) using the SFP synthase (1 µM) and incubated with 100n M of GFP. Next, these cells were washed and subjected to 2-parameter FACS analysis to identify yeast cells that display high levels of a particular Megabody (high CoA-647 fluorescence) and bind the antigen GFP (high GFP fluorescence). Cells that display high levels of a GFP binding Nanobody were sorted and amplified in a glucose-rich medium to be subjected to following rounds of selection by yeast display and two-parameter FACS analysis.

After two rounds of selection, a representative number of highly fluorescent cells in the CoA-647 and GFP channels were grown as single colonies and subjected to DNA sequencing to determine the sequences of a representative number of peptide linkers connecting Nanobody to scaffold protein. Two representative clones of linker types 1-2-1, 2-2-1, 1-2-2, and 2-2-2 amino-acid short linker variants (Table 5) were confirmed to bind to 100 nM GFP in FACS experiments (FIG. 37). This demonstrates that Megabodies concatenated from parts of a single-domain immunoglobulin and parts of a scaffold protein linked by three short polypeptide linkages can be selected from Megabody libraries by in vitro selections and display as functional antigen-binding chimeric proteins.

As we were able to display the functional variants of $Mb_{Nb207}^{Azurin}$ on the surface of yeast (above), we set out to express these antigen-binding chimeric proteins in the periplasm of *E. coli*. Eight $Mb_{Nb207}^{Azurin}$ variants, selected by yeast display (Table 5) were generated as chimeric polypeptides with following amino acid sequences: $Mb_{Nb207}^{Azurin}$ variant (SEQ ID NO:151-158) β-strand A of the anti-GFP-Nanobody (1-12 of SEQ ID NO:1), amino acid linker (Table 5), N-terminal part of Azurin (Residue 3-22 of SEQ ID NO:52), amino acids linker (Table 5), strands B to G of the anti-GFP-Nanobody (residues 17-126 of SEQ ID NO:1), amino acid linker (Table 5), C-terminal part of Azurin (residues 31-128 of SEQ ID NO:52), 6×His/EPEA tag.

In order to express Megabodies like $Mb_{Nb207}^{Azurin}$ variants (SEQ ID NO:151-158) in the periplasm of *E. coli*, we modified the pMESD2 vector, described in Example 2. This new vector (called pMESP5) contains an open reading frame that encodes the following polypeptides: the pelB leader sequence that directs the secretion of the Megabody to the periplasm of *E. coli*, β-strand A of $Nb_{GFP}207$, N-terminal part of Azurin, C-terminal part of any Nanobody (from β-strand B to β-strand G), C-terminal part of Azurin, the 6×His tag and the EPEA tag followed by the Amber stop codon. Eight $Mb_{Nb207}^{Azurin}$ variants (SEQ ID NO: 151-158) were expressed in periplasm of *E. coli* as described in Example 2. The functional properties of the expressed Megabodies were analysed by ELISA as described in Example 7 using periplasmic extracts of each of eight $Mb_{Nb207}^{Azurin}$ variants. Comparison of detected signals for sample with and without immobilized GFP (FIG. 38) clearly confirmed the periplasmic expression of functional $Mb_{Nb207}^{Azurin}$ variants (SEQ ID NO: 151-158). This demonstrates that Megabodies concatenated from parts of a single-domain immunoglobulin and parts of a scaffold protein linked by three short polypeptide linkages can be functionally express in periplasm of E. coli.

TABLE 5

The composition and the length of the yeast-display optimized linker peptides connecting scaffold protein Azurin to a Nanobody.

| Megabody clone | Connection #1 | Connection #2 | Connection #3 | SEQ ID NO: |
|---|---|---|---|---|
| MP1305_A8 | N | NG | A | 151 |
| MP1304_D9 | P | NG | P | 152 |
| MP1304_D10 | GN | GG | K | 153 |
| MP1305_D11 | GE | NG | N | 154 |
| MP1305_G6 | G | ST | DG | 155 |
| MP1304_B8 | G | SR | TM | 156 |
| MP1304_B2 | GG | NG | PP | 157 |
| MP1305_C8 | RI | NG | NY | 158 |

Example 11: Design and Generation of Antigen-Binding Chimeric Proteins Built from a Circularly Permutated Variant of Inverting Glycoside Hydrolase Inserted into the First Exposed β-Turn of a GFP-Specific Nanobody by In Vitro Selection to Produce Homodimeric Megabodies with Structural Symmetry by In Vitro Selection We further designed multimeric Megabodies by grafting Nbs onto the subunits of multimeric scaffold proteins with structural symmetry. Libraries encoding Megabodies built from a Nanobody that was grafted onto reach subunit of a large homodimeric scaffold protein via three short polypeptide linkages that connect Nanobody to scaffold according to FIG. 11 were constructed to identify rigid homo-dimeric Megabodies with a two-fold symmetry by yeast display and FACS.

The homo-dimeric Megabodies (191 kDa per dimer) described here are chimeric polypeptides concatenated from parts of a single-domain immunoglobulin and parts of a scaffold protein linked by three short polypeptide linkers according to FIG. 11. The immunoglobulin used is an anti-GFP-Nanobody as depicted in SEQ ID NO:1. The scaffold protein used was SusB, the homodimeric glucan 1,4-alpha-glucosidase of B. thetaiotaomicron (PDB 3WFA, SEQ ID NO:69). All parts were connected to each other from the amino to the carboxy terminus in the next given order (SEQ ID NO:70-77): β-strand A of the anti-GFP-Nanobody (residues 1-14 of SEQ ID NO:1), a serine, a peptide linker of one or two amino acids with random composition, N-terminal part of SusB (residues 1-68 of SEQ ID NO:69), a peptide linker of one or two amino acids with random composition, β-strands B to G of the anti-GFP-Nanobody (residues 15-125 of SEQ ID NO:1), a peptide linker of one or two amino acids with random composition, C-terminal part of SusB (residues 76-718 of SEQ ID NO:69), 6×His/EPEA tag according to FIG. 13.

To display and select functional representatives of these homodimeric Megabodies in which three short peptides connect the Nanobody to each subunit of the homodimeric scaffold (SEQ ID NO:70-77) on yeast, we used standard methods to construct a library of open reading frames that encode the various Megabodies in fusion to a number of accessory peptides and proteins (SEQ ID NO:78-85): the appS4 leader sequence that directs extracellular secretion in yeast (Rakestraw, 2009), β-strand A of the anti-GFP-Nanobody (residues 1-14 of SEQ ID NO:1), a serine, a peptide linker of one or two amino acids with random composition, N-terminal part of SusB (residues 1-68 of SEQ ID NO:69), a peptide linker of one or two amino acids with random composition, β-strands B to G of the anti-GFP-Nanobody (residues 15-125 of SEQ ID NO:1), a peptide linker of one or two amino acids with random composition, C-terminal part of SusB (residues 76-738 of SEQ ID NO:69), a flexible (GGSG)$_n$ peptide linker, the Aga2p adhesion subunit of the yeast agglutinin protein Aga2p which attaches to the yeast cell wall through disulfide bonds to Aga1p protein, followed by an acyl carrier protein for the orthogonal fluorescent staining of the displayed fusion protein (Johnsson, 2005) and the myc tag. These open reading frames were put under the transcriptional control of galactose-inducible GAL1/10 promotor into the pCTCON2 vector (Chao, 2006) to construct a yeast display library encoding 77.280.000 different variants of the Megabody in which three short peptides connect the Nanobody to each subunit of the homodimeric scaffold according to FIG. 11.

For in vitro selection by yeast display and FACS, this library was introduced into yeast strain EBY100. Transformed cells were grown and induced overnight in a galactose-rich medium in the presence of Ca$^{++}$. Induced cells were orthogonally stained with coA-647 (2 μM) using the SFP synthase (1 μM) and incubated with 100 nM of GFP. Next, these cells were washed and subjected to 2-parameter FACS analysis to identify yeast cells that display high levels of a particular Megabody (high CoA-647 fluorescence) and bind GFP (high GFP fluorescence). Cells that display high levels of a GFP binding were sorted and amplified in a glucose-rich medium to be subjected to following rounds of selection by yeast display and two-parameter FACS analysis.

After multiple rounds of selection, a representative number of highly fluorescent cells in the CoA-647 and GFP channels were grown as single colonies and subjected to DNA sequencing to analyse the length and the composition of the linkers that connect Nanobody to SusB in the multiple Megabody variants that are displayed at high levels and bind antigen, indicating that they express well, can be subjected to cellular secretion and fold into functional GFP-binding chimeric proteins.

One of these homodimeric Megabodies was expressed in and purified to homogeneity from the periplasm of E. coli. The purified protein is crystallized and its structure solved in complex with GFP.

Example 12: Design and Generation of Nanobody-Displaying Icosahedral Virus-Like Particles Built from a Circularly Permutated Variant of a Viral Coat Protein of PP7 Inserted into the First Exposed p-Turn of a GFP-Specific Nanobody by In Vitro Selection Three-dimensional structure determination by cryo-EM involves averaging the information present in 2D projection images of multiple copies of individual particles, which are oriented variably with respect to the incident electron beam. In the case of icosahedral viruses, although each individual virion can be considered a particle, the symmetry of these structures is such that many identical copies of the asymmetrical unit are included in each particle, increasing by many fold the effective number of units averaged to determine the structure. Accordingly, icosahedral viruses that rigidly array Nanobodies following the symmetry imposed by the coat proteins would be the ultimate tool to solve the structures of small proteins and their complexes by Cryo-EM.

Here we designed Nanobody-displaying icosahedral virus-like particles by grafting Nbs onto the coat protein of icosahedral bacteriophages that self-assemble into virus-like particles (VLPs). It was shown that 90 copies of a concatenated dimer of the coat protein of PP7 of an icosahedral bacteriophage of P. Aeruginosa, or 180 coat proteins can self-assemble upon overexpression in E. coli to form icosahedral viral like particles (VLPs) (O'Rourke et al., 2015). In these VLPs, the coat proteins intertwine pairwise with the N-terminus of one monomer very close to the C-terminus of the interlaced monomer. It has also been demonstrated that peptides can be inserted in an exposed loop of this dimer to display this peptide on the surface of the corresponding VLP. Accordingly, we constructed random libraries encoding rigid antibody chimera that are built from a Nanobody that was grafted onto the concatenated dimer of the PP7 coat protein in which two short peptides connect Nanobody to scaffold according to FIG. 2. The 3.9 MDa icosahedral virus-like particles described here self-assemble from chimeric polypeptides built from parts of a single-domain immunoglobulin and parts of a scaffold protein directly linked according to FIG. 14. The immunoglobulin used is a GFP-binding Nanobody as depicted in SEQ ID NO:1. The scaffold protein used is a circular permutated version of a covalent dimer of the coat protein of PP7 (PDB: 1 DWN, SEQ ID NO:2). PP7 is an icosahedral RNA bacteriophage of P. Aeruginosa. All parts were connected to each other from the amino to the carboxy terminus in the next given order (SEQ ID NO:3-6): methionine encoded by the startcodon, β-strand A of the anti-GFP-Nanobody (residues 1-13 of SEQ ID NO:1), the PP7 coat protein (residues 12-128 of SEQ ID NO:2), a peptide linker of one or two amino acids with random composition, a glycine, the PP7 coat protein (residues 2-128 of SEQ ID NO:2), a peptide linker of one or two amino acids with random composition, a glycine, PP7 coat protein (residue 2-8 of SEQ ID NO:2), β-strands B to G of the GFP-binding Nanobody (residues 16-126 of SEQ ID NO:1), 6×His/EPEA tag. This rigid antigen-binding chimeric protein self assembles into an icosahedral VLP (NanoVLP) that displays 90 copies of the Nanobody on its surface (FIG. 14).

To select functional representatives of these engineered GFP-binding coat proteins that self-assemble into NanoVLPs, we used standard methods to construct libraries of open reading frames (SEQ ID NO:3-6) comprising a methionine, the β-strand A of the anti GFP-Nanobody, the circular permutated dimeric PP7 coat protein, the β-strands B to G of the GFP-binding Nanobody, the 6×His/EPEA tag. These DNA fragments were cloned as NdeI-EcoRI fragments in the pMESP vector (ref CA12729, a derivative of pMES4, GenBank GQ907248 where the LguI site was removed) to replace the pelB signal peptide, any Nb sequence, and all detection tags including gene3. This newly created library was called pcPP72Nb$_{GFP}$207L.

For selecting recombinant GFP-binding PP7 coat proteins that can be recombinantly expressed and assembled in vitro to form icosahedral virus-like particles, libraries of chimeric dimers are constructed at the plasmid level. These libraries are used to transform E. coli cells. Chimeric dimers that can assemble into NanoVLPs were expressed in E. coli and subjected to a chromatographic selection. An IMAC purification was performed on the library to select for these clones that express the chimeric dimer and can assemble into a VLP. Since each assembly-competent VLP encapsulated the nucleic acid encoding the Nanobody-coat protein in its shell, we amplified the clones by RT-PCR of the RNA derived from those NanoVLPs. Several clones that express an antigen-binding chimeric protein, were grown as single colonies and subjected to DNA sequencing to determine the sequences of the peptide linkers that connect the first PP7 coat protein to the next PP7 and to determine the sequences of the circular permutation peptide linkers. Individual clones that carry a full length construct were subjected to an ELISA as described in Example 7 to identify the clones that bind GFP (FIG. 39). This demonstrates that the antigen-binding chimeric proteins concatenated from parts of a single-domain immunoglobulin and parts of the (circular permutated) PP7 coat protein linked by polypeptide linkages can be selected from libraries as functional antigen-binding chimeric proteins. Representative clones of with different linker variants are given in Table 6.

TABLE 6

Direct connecting of the PP7 coat protein to a Nanobody (no amino acids) and linkers between the PP7 coat proteins.

| Megabody Clone | connection #1 | linker #1 | connection #2 | linker #2 | SEQ ID |
|---|---|---|---|---|---|
| MP1403_A3 | — | GL | — | RG | 159 |
| MP1403_D3 | — | R | — | PG | 160 |
| MP1403_G5 | — | GV | — | LG | 161 |
| MP1403_E6 | — | W | — | PG | 162 |
| MP1403_D7 | — | R | — | GPG | 163 |
| MP1403_A9 | — | CR | — | RG | 164 |
| MP1403_B9 | — | RV | — | PLG | 165 |

Example 13: Design and Generation of Nanobody-Displaying Icosahedral Virus-Like Particles Built from a Circularly Permutated Variant of a Viral Coat Protein of MS2 Inserted into the First Exposed β-Turn of a Lysozyme-Specific Nanobody by In Vitro Selection The 3.9 MDa icosahedral virus-like particles described here self-assemble from chimeric polypeptides build from parts of a single-domain immunoglobulin and parts of a scaffold protein linked by short polypeptide linkers according to FIG. 15. The immunoglobulin used is a lysozyme-binding Nanobody (PDB: 1 MEL, SEQ ID NO:7). The scaffold protein used was a circular permutated version of a covalent dimer of the coat protein of MS2 (PDB: 2MS2, SEQ ID NO:2). MS2 is an icosahedral RNA bacteriophage of Escherichia coli. All parts were connected to each other from the amino to the carboxy terminus in the next given order (SEQ ID NO:9-13): a methionine encoded by the start codon, Nanobody β-strand A (β-strand A of the anti-GFP-Nanobody, residues 1-12), circular permutation linker of two amino acids with random composition, the MS2 coat protein (residues 17-130 of SEQ ID NO:8; followed by residues 2-130 of SEQ ID NO:8 and residues 2-14 of SEQ ID NO:8), β-strands B to G of the lysozyme-binding Nanobody (residues 17-133 of SEQ ID NO:7), 6×His/EPEA tag. This rigid antigen-binding chimeric protein self assembles into an icosahedral VLP that displays 90 copies of the Nanobody on its surface (FIG. 15).

To select functional representatives of these engineered lysozyme-binding coat proteins that self-assemble into NanoVLPs, we used standard methods to construct libraries of open reading frames (SEQ ID NO:9-13) comprising a methionine, the β-strand A of the anti GFP-Nanobody, the circular permutated dimeric MS2 coat protein, the β-strands B to G of the lysozyme-binding Nanobody, the 6×His/EPEA tag. These DNA fragments were cloned as NdeI-EcoRI fragments in the pMESP vector (ref CA12729). This newly created plasmid library was called pcMS22cAb$_{Lys}$3L.

For selecting recombinant lysozyme-binding MS2 coat proteins that can be recombinantly expressed and assembled in vitro to form icosahedral virus-like particles, libraries of NanoVLPs are constructed at the plasmid level. These libraries are used to transform E. coli cells. NanoVLPs were expressed in E. coli and subjected to a chromatographic selection for VLP assembly. Since each assembly-competent VLP encapsulated the nucleic acid encoding the Nanobody-coat protein in its shell, sequencing by RT-PCR of the RNA derived from those NanoVLPs that can be purified by precipitation followed by size exclusion chromatography reveals the genes enriched by selection for assembly. Upon affinity selection using lysozyme, RNA is isolated and amplified from those NanoVLPs that bind specifically to lysozyme. Some assemble-competent lysozyme specific NanoVLPs, built from these lysozyme-binding MS2 coat proteins, were purified to homogeneity and analysed by single particle cryo-EM in the presence and absence of lysozyme.

Example 14: Design and Generation of Nanobody-Displaying Icosahedral Virus-Like Particles Built from a Natural Permutated Viral Coat Protein of AP205 Inserted into the First Exposed β-Turn of a GFP-Specific Nanobody by In Vitro Selection The dimers described here self-assemble from chimeric polypeptides build from parts of a single-domain immunoglobulin and parts of a scaffold protein linked by short polypeptide linkers according to FIG. 40. The immunoglobulin used is a GFP-binding Nanobody (SEQ ID NO:1). The scaffold protein used was a covalent dimer of the coat protein of AP205 (PDB: 5FS4, SEQ ID NO: 166). AP205 is an icosahedral RNA bacteriophage of Acinetobacter bacteria. The AP205 coat protein dimer adopts the conserved Leviviridae coat protein fold except for the N-terminal region, which forms a beta-hairpin in the other known single-stranded RNA phages. AP205 has a similar structure at the same location formed by N- and C-terminal beta-strands, making it a circular permutant compared to the other coat proteins. The permutation moves the coat protein termini to the most surface-exposed part of the assembled particle, which explains its increased tolerance to long N- and C-terminal fusions (Shishovs et al., 2016).

All parts were connected to each other from the amino to the carboxy terminus in the next given order (SEQ ID NO:167): a methionine encoded by the start codon, Nanobody β-strand A (β-strand A of the anti-GFP-Nanobody, residues 1-11), a random linker of one amino acid, the AP205 coat protein dimer (residues 4-128 of SEQ ID NO:166; followed by residues 4-126 of SEQ ID NO:166), β-strands B to G of the GFP-binding Nanobody (residues 16-126 of SEQ ID NO:1), 6×His/EPEA tag. To select functional representatives of such antigen-binding chimeric proteins, we used standard methods to construct libraries of open reading frames comprising a methionine, the β-strand A of the anti GFP-Nanobody, the dimeric AP205 coat protein, the β-strands B to G of the GFP-binding Nanobody, the 6×His/EPEA tag. These DNA fragments are cloned as NdeI-EcoRI fragments in the pMESP vector (ref CA12729). This newly created plasmid was called pMESAP2052XXPNb$_{GFP}$207. For selecting antigen-binding chimeric (AP205) proteins that can be recombinantly expressed and assembled correctly in vitro, libraries of antigen-binding chimeric proteins are constructed at the plasmid level. These libraries are used to transform E. coli cells. To identify chimeric proteins that assemble correctly as chimeric dimers, individual clones were expressed in E. coli and subjected to an ELISA as described in Example 7 to screen for clones that bind GFP (FIG. 41). Several clones that express a Mb$_{Nb207}^{AP205x2}$XX that binds GFP, were grown as single colonies and subjected to DNA sequencing to determine the sequences of the peptide linkers connecting Nanobody to scaffold protein. This demonstrates that the antigen-binding chimeric proteins concatenated from parts of a single-domain immunoglobulin and parts of the viral AP205 coat protein linked by two short polypeptide linkages can be selected from libraries as functional antigen-binding chimeric proteins. Representative clones of 1-1 amino-acid short linker variants are given in Table 7. We found that some of these antigen-binding chimeric proteins self assembles into icosahedral VLPs that display 90 copies of the Nanobody on the surface.

TABLE 7

The composition of the linker peptides connecting the AP205 coat protein to Nanobody.

| clone | Connection #1 | Connection #2 | SEQ ID NO: |
|---|---|---|---|
| MP1444_C5 | Y | N | 168 |
| MP1445_B7 | V | P | 169 |
| MP1443_B8 | S | L | 170 |
| MP1445_D3 | L | G | 171 |
| MP1445_A4 | R | S | 172 |

Example 15: Design and Generation of a Dimeric Antigen-Binding Chimeric Protein Composed of Two Polypeptide Chains that are Built from the Coat Protein of AP205 that was Inserted into the First β-Turn Connecting β-Strands A and B of a GFP-Specific Nanobody by In Vitro Selection The dimers described here self-assemble from chimeric polypeptides built from parts of a single-domain immunoglobulin and parts of a scaffold protein linked by short polypeptide linkers according to FIG. 42.

The immunoglobulin used is a GFP-binding Nanobody (SEQ ID NO:1). The scaffold protein used was the AP205 (PDB: 5FS4, SEQ ID NO: 166). When the AP205 monomers assemble into dimers or a VLP, the N-terminus of one monomer comes in close proximity of the C-terminus of a second monomer and vice versa. To get functional antigen binding chimeras the β-strand A of a first monomer needs to combine with the β-strands B to G of the GFP-binding Nanobody of a second monomer and the β-strands B to G of the GFP-binding Nanobody of the second monomer needs to combine with β-strand A of the first monomer to assemble into a dimeric antigen-binding chimeric protein.

All parts were connected to each other from the amino to the carboxy terminus in the next given order (SEQ ID NO:173): a methionine encoded by the start codon, Nanobody β-strand A (β-strand A of the anti-GFP-Nanobody, residues 1-11), a random linker of one amino acid, the AP205 coat protein (residues 4-126 of SEQ ID NO:166), β-strands B to G of the GFP-binding Nanobody (residues 16-126 of SEQ ID NO:1), 6×His/EPEA.

To select functional representatives of such dimeric antigen-binding chimeric proteins, we used standard methods to construct libraries of open reading frames comprising a methionine, the β-strand A of the anti GFP-Nanobody, the monomeric AP205 coat protein, the β-strands B to G of the GFP-binding Nanobody, the 6×His/EPEA tag. These DNA fragments are cloned as NdeI-EcoRI fragments in the pMESP vector. This newly created plasmid was called pMESAP2051XXPNb$_{GFP}$207.

For selecting dimeric antigen-binding chimeric proteins that can be recombinantly expressed and correctly assembled in vitro, these libraries of dimeric antigen-binding chimeric proteins are constructed at the plasmid level. These libraries are used to transform E. coli cells. To identify chimeric proteins that assemble correctly as dimers, individual clones were expressed in E. coli and subjected to ELISA as described in Example 7 to screen for clones that bind GFP (FIG. 43). Several clones that express a dimers of Mb$_{Nb207}^{AP205}$XX that binds GFP, were grown as single colonies and subjected to DNA sequencing to determine the sequences of the peptide linkers connecting Nanobody to scaffold protein. This demonstrates that the dimeric antigen-binding chimeric proteins concatenated from parts of a single-domain immunoglobulin and parts of the viral AP205 coat protein linked by two short polypeptide linkages can be selected from libraries as functional dimeric antigen-binding chimeric proteins. Representative clones of 1-1 amino-acid short linker variants are given in Table 8.

If 2 antigen-binding chimeric proteins with a different antigen binding domain, one for example a GFP-binding Nanobody and a FedF-binding Nanobody, are co-expressed in the cell, they can assemble as a heterodimeric chimeric protein.

TABLE 8

The composition of the linker peptides connecting the AP205 coat protein to Nanobody.

| clone | Connection #1 | Connection #2 | SEQ ID NO: |
|---|---|---|---|
| MP1450_C12 | W | S | 174 |
| MP1453_A4 | M | G | 175 |
| MP1450_E8 | R | I | 176 |
| MP1450_D10 | S | H | 177 |

Example 16: Design and Generation of Antigen-Binding Chimeric Proteins Built from ACP Inserted into the First β-Strand AB-Connecting β-Turn of a GFP-Specific Nanobody by In Vitro Selection Building on the successful design of our first Megabodies, we also tested if immunoglobulin domains can also by rigidly grafted onto scaffolds that can be labelled with a fluorophore, dye, ion or metal to be used in diagnosis, imaging or in other biophysical applications. Accordingly, we constructed random libraries encoding rigid antibody chimera that are built from a Nanobody that was grafted onto ACP in which two short peptides connect Nanobody to scaffold according to FIG. 2 (but without the need for a circular permutation in the scaffold) to produce rigid antigen-binding chimeric proteins that can be labelled orthogonally to a specific serine (FIG. 16) by use of fluorescent derivatives of CoA and SFP synthases (Yin et al, 2006).

The Nanotool described here are chimeric polypeptide concatenated from parts of single-domain immunoglobulin and parts of a scaffold protein connected by short polypeptide linkages according to FIG. 2. In this particular Megabody, no circular permutation of the scaffold protein was required because the N-terminus and the C-terminus of wild type ACP are close to each other and well positioned for engineering two short polypeptide linkages that connect Nanobody to ACP (FIG. 16). The immunoglobulin used is a GFP-binding Nanobody as depicted in SEQ ID NO:1. The scaffold protein is the acyl carrier protein of Escherichia coli (PDB:1T8K, SEQ ID NO:86), abbreviated as ACP. All parts were connected to each other from the amino to the carboxy terminus in the next given order by peptide bonds (SEQ ID NO:87-90): β-strand A of the anti-GFP-Nanobody (residues 1-11 of SEQ ID NO:1), a peptide linker of one or two amino acids with random composition, ACP (residues 2-76 of SEQ ID NO:86), a peptide linker of one or two amino acids with random composition, β-strands B to G of the Nanobody (residues 17-126 of SEQ ID NO:1), 6×His/EPEA tag according to FIG. 2.

To display and select functional representatives of these NanoTools in which two short peptides connect the Nanobody to ACP (SEQ ID NO:87-90) on yeast, we used standard methods to construct a library of open reading frames that encode the various Mb$_{Nb207}^{ACP}$ Toolbodies in fusion to a number of accessory peptides and proteins (SEQ ID NO:91-94): the appS4 leader sequence that directs extracellular secretion in yeast (Rakestraw, 2009), β-strand A of the anti-GFP-Nanobody (residues 1-11 of SEQ ID NO:1), a peptide linker of one or two amino acids with random composition, ACP (residues 2-76 of SEQ ID NO:86), a peptide linker of one or two amino acids with random composition, β-strands B to G of the Nanobody (residues 17-126 of SEQ ID NO:1), a flexible (GGSG)$_n$ peptide linker, the Aga2p adhesion subunit of the yeast agglutinin protein Aga2p which attaches to the yeast cell wall through disulphide bonds to Aga1p protein, followed by the myc tag. These open reading frames were put under the transcriptional control of galactose-inducible GAL1/10 promotor into the pCTCON2 vector (Chao, 2006) to construct a yeast display library encoding 77.280.000 different variants of the Nanotool in which two short peptides connect the Nanobody to ACP scaffold according to FIG. 16.

For in vitro selection by yeast display and FACS, this library was introduced into yeast strain EBY100. Transformed cells were grown and induced overnight in a galactose-rich medium. Induced cells were orthogonally stained with coA-647 (2 μM) using the SFP synthase (1 μM) and incubated with 100 nM of GFP. Next, these cells were washed and subjected to 2-parameter FACS analysis to identify yeast cells that display high levels of a particular Nanotool (high CoA-647 fluorescence) and bind GFP (high GFP fluorescence). Cells that display high levels of a GFP binding were sorted and amplified in a glucose-rich medium to be subjected to following rounds of selection by yeast display and two-parameter FACS analysis.

After one round of selection, a representative number of highly fluorescent cells in the CoA-647 and GFP channels were grown as single colonies and subjected to DNA sequencing to determine the sequences of a representative number of peptide linkers connecting Nanobody to scaffold protein. Two representative clones of 1-1, 2-1 and 2-2 amino-acid short linker variants (Table 9) were confirmed to bind to 100 nM GFP in FACS experiments (FIG. 44). This demonstrates that NanoTools concatenated from parts of a single-domain immunoglobulin and parts of acyl carrier protein linked by two short polypeptide linkages can be selected from Megabody libraries and display as functional antigen-binding chimeric proteins. As we were able to display the functional variants of $Mb_{Nb207}{}^{ACP}$ NanoTool on the surface of yeast (above), we set out to express these antigen-binding chimeric proteins in the periplasm of E. coli. Six $Mb_{Nb207}{}^{ACP}$NanoTool variants, selected by yeast display (Table 9) were generated as chimeric polypeptides with following amino acid sequences $Mb_{Nb207}{}^{ACP}$ variants (SEQ ID NO:178-183): β-strand A of the anti-GFP-Nanobody (residues 1-11 of SEQ ID NO:1), amino acid linker (Connection #1 Table 9), ACP (residues 2-76 of SEQ ID NO:86), amino acid linker (Connection #2 Table 9), β-strands B to G of the Nanobody (residues 17-126 of SEQ ID NO:1), 6×His/EPEA tag.

In order to express those variants in E. coli, the pMESD2 vector was modified, described in Example 2. This new vector (called pMESP6) contains an open reading frame that encodes the following polypeptides: the pelB leader sequence that directs the secretion of the NanoTool to the periplasm of E. coli, β-strand A of $Nb_{GFP}207$, ACP, C-terminal part of any Nanobody (from β-strand B to β-strand G), the 6×His/EPEA tag followed by the Amber stop codon. Six $Mb_{Nb207}{}^{ACP}$ NanoTool variants (SEQ ID NO:178-182) were expressed as described in Example 2. The functional properties of the expressed Nanotools were next analysed by ELISA as described in Example 7, using periplasmic extracts of each of six $Mb_{Nb207}{}^{ACP}$NanoTool variants. Comparison of detected signals for sample with and without immobilized GFP (FIG. 45) clearly confirmed the periplasmic expression of functional $Mb_{Nb207}{}^{ACP}$ NanoTool variants. This demonstrates that NanoTools concatenated from parts of a single-domain immunoglobulin and parts of the Acyl carrier protein linked by two short polypeptide linkages can be functionally express in periplasm of E. coli.

TABLE 9

The composition and length of the yeast-display optimized linker peptides connecting scaffold protein Acyl carrier protein to Nanobody.

| NanoTool clone | Connection #1 | Connection #2 | SEQ ID NO: |
|---|---|---|---|
| MP1288_A3 | G | Y | 178 |
| MP1288_A10 | K | R | 179 |
| MP1302_D10 | RT | P | 180 |
| MP1302_D2 | IF | S | 181 |
| MP1302_C10 | LE | NL | 182 |
| MP1302_F1 | WY | NL | 183 |

Example 17: Design and Generation of Antigen-Binding Chimeric Proteins Built from a GFP-Specific Nanobody Inserted into the First β-Strand AB-Connecting β-Turn of a Lysozyme-Specific Nanobody by In Vitro Selection Using Phage Display It was further investigated whether a Nanobody itself can be applied as a scaffold protein, so whether Nanobodies can also be rigidly fused to an identical or a different Nanobody to produce bivalent or bispecific antigen-binding chimeric proteins. Accordingly, a Nanobody was grafted onto another Nanobody via three polypeptide linkages that connect Nanobody to scaffold according to FIG. 17 to build a rigid Nb—Nb chimer (Nano2body). The linking was performed in such way that the paratopes of both Nbs are free to bind their respective antigen. Accordingly, this fusion is able to bind with a higher avidity if both Nanobodies of the Nano2body bind the same antigen or is capable to bind and crosslink two different antigens if each Nanobody of the Nano2body binds a different antigen.

The Nano2bodies described here (FIG. 18) are chimeric polypeptides concatenated from parts of a first Nanobody and parts of another (different) Nanobody linked by short polypeptide linkages according to FIG. 17. The first Nanobody used is a GFP-binding Nanobody ($Nb_{GFP}207$) as depicted in SEQ ID NO:1. The second Nanobody binds hen egg-white lysozyme ($cAb_{Lys}3$, PDB 1 MEL, SEQ ID NO:7) (Desmyter A et al., 1996). All parts were connected to each other from the amino to the carboxy terminus in the next given order by peptide bonds (SEQ ID NO:14) as depicted in FIG. 18: β-strand A of the anti-GFP-Nanobody $Nb_{GFP}207$ (residues 1-15, SEQ ID NO: EP1), a peptide linker of three amino acids with random composition, a glycine, $Nb_{GFP}207$ (Residue 2-118, SEQ ID NO:1), a peptide linker of two amino acids with random composition, β-strands B to G of the lysozyme-binding Nanobody (residues 16-133 of SEQ ID NO:7), a peptide linker of three amino acids with random composition, the last part of the G-strand of $Nb_{GFP}207$ (residues 117-126 of SEQ ID NO:1), 6×His/EPEA tag.

To display and select functional representatives of these Nano2bodies (SEQ ID NO: 14) on filamentous phage, we used standard methods to construct libraries of open reading frames that encode the various Nano2bodies in fusion to a number of accessory peptides and proteins. For this the pMESP1 vector carrying a pelB signal peptide and the pMESD1 vector carrying the DsbA signal peptide, both containing the β-strand A, were adapted in such a way that 2 Nanobodies can be inserted to create Nano2bodies: SEQ ID NO:15: the PeIB leader sequence directs the secretion of the fusion protein to the periplasm of E. coli, the β-strand A of the anti-GFP-Nanobody $Nb_{GFP}207$ (residues 1-15, SEQ ID NO:1), a peptide linker of three amino acids with random composition, a glycine, $Nb_{GFP}207$ (residues 2-118, SEQ ID NO:1), a peptide linker of two amino acids with random composition, β-strands B to G of the lysozyme-binding Nanobody (residues 16-133 of SEQ ID NO:7), a peptide linker of three amino acids with random composition, the last part of the G-strand of $Nb_{GFP}207$ (residues 117-126 of SEQ ID NO:1), 6×His/EPEA tag, an amber stop codon, the HA tag and protein 3 of the M13 phage. Or Nano2body SEQ ID NO:16: the DsbA leader sequence directs the secretion of the fusion protein to the periplasm of E. coli, the β-strand A of the anti-GFP-Nanobody $Nb_{GFP}207$ (residues 1-15, SEQ ID NO:1), a peptide linker of three amino acids with random composition, a glycine, $Nb_{GFP}207$ (residues 2-118, SEQ ID NO:1), a peptide linker of two amino acids with random composition, β-strands B to G of the lysozyme-binding Nanobody (residues 16-133 of SEQ ID NO:7), a peptide linker of three amino acids with random composition, the last part of the G-strand of $Nb_{GFP}207$ (residues 117-126 of SEQ ID NO:1), 6×His tag/EPEA tag, an amber stop codon, the HA tag and protein 3 of the M13 phage.

Example 18: Design and Generation of Antigen-Binding Chimeric Proteins Built from a GFP-Specific Nanobody Inserted into the First β-Strand AB-Connecting β-Turn of a FedF-Specific Nanobody by In Vitro Selection Using Phage Display We also tested if Nanobodies can be rigidly fused to an identical or a different Nanobody to produce bivalent or bispecific antigen-binding chimeric proteins. Accordingly, a Nanobody was grafted onto another Nanobody via three polypeptide linkages that connect Nanobody to scaffold according to FIG. 17 to build a rigid Nb—Nb chimer (Nano2body; N2b). The linking was performed in such way that the paratopes of both Nbs are free to bind their respective antigen. Accordingly, this fusion will be able to bind with a higher avidity if both monomers bind the same antigen or will be able to bind two different antigens if each monomer binds a different antigen.

The Nano2bodies described here (FIG. 19) are chimeric polypeptides concatenated from parts of a first Nanobody and parts of another (different) Nanobody linked by short polypeptide linkages according to FIG. 19. The first Nanobody used is a GFP-binding Nanobody ($Nb_{GFP}207$) as depicted in SEQ ID NO:1. The second Nanobody recognizes the lectin domain of the F18 fimbrial adhesin FedF ($Nb_{FedF}9$, SEQ ID NO:17) (Moonens et al., 2014). All parts were connected to each other from the amino to the carboxy terminus in the next given order by peptide bonds (SEQ ID NO:18) as depicted in FIG. 19: β-strand A of the anti-GFP-Nanobody $Nb_{GFP}207$ (residues 1-15, SEQ ID NO: 1), a peptide linker of three amino acids with random composition, a glycine, $Nb_{GFP}207$ (Residue 2-118, SEQ ID NO:1), a peptide linker of two amino acids with random composition, β-strands B to G of the FedF-binding Nanobody (residues 16-129 of SEQ ID NO:17), a peptide linker of three amino acids with random composition, the last part of the G-strand of $Nb_{GFP}207$ (residues 117-126 of SEQ ID NO:1), 6×His/EPEA tag.

As the highly conserved N-terminal sequence and the highly conserved C-terminal sequence are common to all Nbs, in vivo-matured Nanobody repertoires can conveniently be cloned in a very similar way.

Two versions of the Nano2body can be made: $Nb_{GFP}207$ as the first binding domain and NbFedF9 as the second binding domain and vice versa.

To simplify the screening we used computational modelling to start from an energetically stable construct (SEQ ID NO: 184-185) as depicted in FIG. 46. To display and select functional representatives of these Nano2bodies on filamentous phage, we used standard methods to construct libraries of open reading frames that encode the various Nano2bodies in fusion to a number of accessory peptides and proteins. For this the pMESP1 vector carrying a pelB signal peptide and the pMESD1 vector carrying the DsbA signal peptide, both containing the β-strand A, were adapted in such a way that 2 Nanobodies can be inserted to create a Nano2body: SEQ ID NO: 184-185. In the pMESP construct the PelB leader sequence directs the secretion of the antigens-binding chimeric protein to the periplasm of E. coli, in the pMESD construct the DsbA leader sequence directs the secretion of the antigens-binding chimeric protein to the periplasm of E. coli. All parts were connected to each other from the amino to the carboxy terminus in the next given order by peptide bonds: the signal peptide, the β-strand A of the anti-GFP-Nanobody $Nb_{GFP}207$ (residues 1-13, SEQ ID NO:1), a peptide linker of four amino acids: TENH (residues 14-17, SEQ ID NO: 184-185), $Nb_{GFP}207$ (residues 3-116, SEQ ID NO:1, with the mutation V to Q in residu 5), a peptide linker of four amino acids with random composition, β-strands B to G of the FedF-binding Nanobody (residues 16-128 of SEQ NO:17), a peptide linker of three amino acids: GQE (residues 249-251 of SEQ ID NO:184) or GQQ (residues 249-251 of SEQ ID NO:185), the last part of the G-strand of $Nb_{GFP}207$ (residues 117-126 of SEQ ID NO:1), the 6×His/EPEA tag, an amber stop codon, the HA tag and protein 3 of the M13 phage.

For selecting antigen-binding chimeric proteins that can be recombinantly expressed in vitro, libraries of antigen-binding chimeric proteins are constructed at the plasmid level. The library with DNA fragments cloned in the pMESP vector was called pMESPNIIb$_{GFP}$207X$_{FedF}$9, the library with DNA fragments cloned in the pMESP vector was called pMESDNIIb$_{GFP}$207X$_{FedF}$9. These libraries were used to transform E. coli cells. To identify chimeric proteins that assemble correctly, we performed 1 or 2 rounds of in vitro selection via phage display (Pardon et al., 2014) on FedF followed by one round of selection on GFP. After selection, individual clones were picked and the DNA fragments of interest were PCRed, the size of each clone was checked on α1% agarose gel. Several clones harboring DNA fragments of the correct size were sequence analyzed to determine the sequences of the peptide linkers connecting the different Nanobody fragments. Correct clones were expressed in E. coli, semi purified using IMAC and subjected to an ELISA to screen for clones that express and bind to GFP and to FedF (FIG. 47) as described as follows: Purified GFP and FedF were separately immobilized in wells of a maxisorp microtitre plate (Nunc) at a concentration of 0,5 µg/well in sodium bicarbonate buffer pH 8.2. Residual protein binding sites in the wells were blocked for two hours at room temperature with milk in PBS. IMAC purified Nano2body samples were incubated on GFP coated, on FedF coated and on non-coated wells. After washing steps, the binding of Nano2bodies to GFP was examined by using the CaptureSelect C-tag biotinylated antibody (Life Technologies) that specifically recognizes the EPEA-tag, present only on the Nano2body. Subsequent detection of CaptureSelect biotinylated antibody was done with Streptavidin-Alkaline phosphatase (Promega). The absorption at 405 nm was measured after adding the enzyme substrate p-nitrophenyl phosphate. Detected signals show that some these antigens-binding chimeric proteins are able to recognize GFP and FedF. This demonstrates that the Nano2body concatenated from parts of a single-domain immunoglobulin and parts of a different single-domain immunoglobulin linked by three short polypeptide linkages can be selected from libraries as functional antigens-binding chimeric proteins. Representative clones of 4-4-3 amino-acid short linker variants are given in Table 10.

TABLE 10

The composition of the linker peptides connecting both Nanobodies.

| clone ID | | connection #1 | connection #2 | connection #3 | SEQ ID NO: |
|---|---|---|---|---|---|
| CA14543 | MP1411_B3 | TENH | WGSL | GQE | 186 |
| CA14544 | MP1411_C6 | TENH | GVLL | GQQ | 187 |
| CA14546 | MP1438_A5 | TENH | AQWM | GQQ | 188 |
| CA14548 | MP1438_B11 | TENH | SEVR | GQE | 189 |
| CA14550 | MP1438_D2 | TENH | RAAA | GQE | 190 |
| CA14552 | MP1440_C5 | TENH | VEAA | GQQ | 191 |

Example 19: Display Vectors for the Selection of GFP-Specific Antigen-Binding Chimeric Proteins from Immune Libraries by Yeast Display or Phage Display As part of the framework of the immunoglobulin fold, the N-terminal amino acid sequence (including β-strand A and the residues that form the β-turn that connects β-strand A to B) is highly conserved amongst different camelid antibodies (Harmsen, 2000). As a consequence, the same linkers can be used to insert a particular scaffold into the first β-turn that connects β-strand A to B of any Nanobody to produce well folded and stable Megabodies, once the length and the sequence of the linker peptides that connect one representative Nanobody to the scaffold have been optimized (see previous Examples). Similarly, the C-terminal sequences of different camelid antibodies are highly conserved. The same linker can thus be used to connect the C-terminus of a Nanobody to the scaffold, once the length and the sequence of this linker peptide that connects one representative Nanobody to the scaffold has been optimized.

It follows that in vivo matured libraries of Nanobodies can conveniently be used to clone large libraries of rigid antigen-binding chimeric proteins according to the linking schemes presented in FIGS. 2 or 11 amongst others. These libraries can be screened by phage display, yeast display or viral display for functional Megabodies, multimeric Megabodies with symmetry, VLPs, Nanotools or Nano2bodies of a particular design, depending on the anticipated application. To proof this concept, a Nanobody immune library was grafted onto the scaffold protein HopQ via two peptide bonds that connect Nanobody to scaffold according to FIG. 2 to build a library for the display of a large repertoire of rigid antigen-binding chimeric proteins that is assembled from different Nanobodies that are grafted onto the same scaffold (FIG. 20). The Megabodies described here are chimeric polypeptides concatenated from parts of single-domain immunoglobulins and parts of a scaffold protein connected by short polypeptide linkages according to FIG. 2. The immunoglobulins are Nanobodies that have been cloned from a blood sample of a Llama that was immunized with GFP as described in Pardon et al. (2014). All parts were connected to each other from the amino to the carboxy terminus in the next given order by peptide bonds: β-strand A of the anti-GFP-Nanobody (residues 1-13 of SEQ ID NO:1), a C-terminal part of HopQ (residues 192-414 of SEQ ID NO:19), a short peptide linker (SEQ ID NO:21) connecting the C-terminus and the N-terminus of HopQ to produce a circular permutant of the scaffold protein, an N-terminal part of HopQ (residues 14-186 of SEQ ID NO:19), β-strands B to G of a Nanobody derived from a Llama that was immunized with GFP. The Nanobody-encoding genes were cloned from this immunized animal as described in Pardon et al. (2014). To display and select novel functional GFP-binding Megabodies in which two short peptides connect other GFP-specific Nanobodies to the scaffold on yeast, we amplified the Nanobody-encoding genes with primers TU64 (SEQ ID NO:124) and TU65 (SEQ ID NO:125) and used GAP repair homologous recombination in yeast to construct the following library of open reading frames encoding these Megabodies in fusion to a number of accessory peptides and proteins according to FIG. 8 the appS4 leader sequence that directs extracellular secretion in yeast (Rakestraw, 2009), the cHopQNb_from_immune_library Megabody library, a flexible peptide linker, the Aga2p adhesion subunit of the yeast agglutinin protein Aga2p which attaches to the yeast cell wall through disulfide bonds to Aga1p protein, an acyl carrier protein for the orthogonal fluorescent staining of the displayed fusion protein (Johnsson, 2005) followed by the cMyc Tag. These open reading frames were put under the transcriptional control of galactose-inducible GAL1/10 promotor into the pCTCON2 vector (Chao, 2006) to construct a yeast display library encoding 107 different Megabodies in which two short peptides connect a Nanobody from the immune library to HopQ.

For in vitro selection by yeast display and FACS, this library was introduced into yeast strain EBY100. Transformed cells were grown and induced overnight in a galactose-rich medium. Induced cells were orthogonally stained with coA-647 (2 μM) using the SFP synthase (1 μM) and incubated with 200 nM of GFP. Next, these cells were washed and subjected to 2-parameter FACS analysis to identify yeast cells that display high levels of a particular Megabody (high CoA-647 fluorescence) and bind GFP (high GFP fluorescence). Cells that display high levels of a GFP binding were sorted and amplified in a glucose-rich medium to be subjected to following rounds of selection (with lower GFP concentration 100 nM, 10 nM and 1 nM) by yeast display and two-parameter FACS analysis.

After multiple rounds of selection, a representative number of highly fluorescent cells in the CoA-647 and GFP channels were grown as single colonies and subjected to DNA sequencing to determine the sequences of a representative number of Megabodies that are displayed at high levels and bind GFP. Nine different GFP-specific Megabodies (SEQ ID NO: 95-103, see also FIG. 21) that bind to 100 nM GFP in FACS experiments were identified, demonstrating that antigen-binding chimeric proteins can be selected from Megabody libraries that are derived from immune libraries.

Example 20. Design and Generation of 58 kD Antigen-Binding Chimeric Proteins Built from a Circularly Permutated Variant of HopQ Inserted into the Second β-Strand CC'-Connecting β-Turn of a GFP-Specific Nanobody by In Vitro Selection Examples 1-17 illustrate that antigen-binding chimeric proteins can be built from scaffold proteins that are inserted into the first β-turn of a Nanobody connecting β-strands A to B. To demonstrate that scaffolds can also be connected to the immunoglobulin domain via other turns, we also constructed antigen-binding chimeric proteins from cHopQ scaffold protein inserted in the second exposed β-turn (connecting β-strands C and C') of a GFP-specific Nanobody by in vitro selection.

The 58 kDa Megabodies described here are chimeric polypeptides concatenated from parts of a single-domain immunoglobulin and parts of a scaffold protein connected by short polypeptide linkages according to FIG. 22. Here, the immunoglobulin used is a GFP-binding Nanobody as depicted in SEQ ID NO:1. All parts were connected to each other from the amino to the carboxy terminus in the next given order by peptide bonds (SEQ ID NO:104-107): β-strand A to C of the anti-GFP-Nanobody (1-39 of SEQ ID NO:1), a peptide linker of one or two amino acids with random composition, a C-terminal part of HopQ (residues 193-414 of SEQ ID NO:19), a peptide linker (SEQ ID NO:21) connecting the C-terminus and the N-terminus of HopQ to produce a circular permutant of the scaffold protein, an N-terminal part of HopQ (residues 15-186 of SEQ ID NO:19), a peptide linker of one or two amino acids with random composition, β-strands C' to G of the anti-GFP-Nanobody (residues 46-126 of SEQ ID NO:1), /EPEA tag.

To display and select functional variants of Megabodies in which a circular permutant of HopQ is inserted in the second β-turn of a GFP-specific Nanobody on yeast, we used standard methods to construct a library of open reading frame that encode the various Megabodies in fusion to a number of accessory peptides and proteins (SEQ ID NO:108-111): the appS4 leader sequence that directs extracellular secretion in yeast (Rakestraw, 2009), β-strand A to C of the anti-GFP-Nanobody (1-39 of SEQ ID NO:1), a peptide linker of one or two amino acids with random composition, a C-terminal part of HopQ (residues 193-414 of SEQ ID NO:19), a peptide linker (SEQ ID NO:21) connecting the C-terminus and the N-terminus of HopQ to produce a circular permutant of the scaffold protein, an N-terminal part of HopQ (residues 15-186 of SEQ ID NO:19), a peptide linker of one or two amino acids with random composition, β-strand C' to G of the anti-GFP-Nanobody (residues 46-126 of SEQ ID NO:1), a flexible $(GGSG)_n$ peptide linker, the Aga2p adhesion subunit of the yeast agglutinin protein Aga2p which attaches to the yeast cell wall through disulfide bonds to Aga1p protein, followed by an acyl carrier protein for the orthogonal fluorescent staining of the displayed fusion protein (Johnsson, 2005) and the myctag. These open reading frames were put under the transcriptional control of galactose-inducible GAL1/10 promotor into the pCTCON2 vector (Chao, 2006) to construct a yeast display library encoding 184.000 different variants of the Megabody described in FIG. 22).

For in vitro selection, this library was introduced into yeast strain EBY100. Transformed cells were grown and induced overnight in a galactose-rich medium. Induced cells were orthogonally stained with coA-647 (2 μM) using the SFP synthase (1 μM) and incubated with 100 nM of GFP. Next, these cells were washed and subjected to 2-parameter FACS analysis to identify yeast cells that display high levels of a particular Megabody (high CoA-647 fluorescence) and bind the antigen GFP (high GFP fluorescence). Cells that display high levels of a GFP binding Nanobody were sorted and amplified in a glucose-rich medium to be subjected to following rounds of selection by yeast display and two-parameter FACS analysis.

After one round of selection, a representative number of highly fluorescent cells in the CoA-647 and GFP channels were grown as single colonies and subjected to DNA sequencing to determine the sequences of a representative number of peptide linkers connecting Nanobody to scaffold protein. One or two representative clones of 1-1, 2-1, 1-2 and 2-2 amino-acid short linker variants (Table 11) were confirmed to bind to 100 nM GFP in FACS experiments (FIG. 48). This demonstrates that Megabodies, which scaffold protein is inserted in the second exposed β-turn (connecting β-strands C and C') of single-domain immunoglobulin and connected by two short polypeptide linkages can be selected from Megabody libraries by in vitro selections and displayed as functional antigen-binding chimeric proteins.

TABLE 11

The composition and length of the yeast-display optimized linker peptides connecting scaffold protein to the second exposed β-turn of Nanobody (between β-strands C and C').

| Megabody clone | Connection #1 | Connection #2 |
|---|---|---|
| MP1327_C6 | R | N |
| MP1327_E4 | R | M |
| MP1327_D5 | C | SL |
| MP1327_F6 | NP | D |
| MP1327_B4 | QE | YT |
| MP1327_B5 | LN | HW |

Example 21. Design and Generation of Other 58 kD Antigen-Binding Chimeric Proteins Built from cHopQ Inserted into the First β-Strand AB-Connecting β-Turn of a K-Ras-Specific Monobody by In Vitro Selection Here we described an antigen-binding chimeric protein based on a synthetic antigen-binding domain, such as a Monobody. Megabodies were built from cHopQ scaffold protein inserted into the first β-turn connecting β-strands A and B of the H-RAS and K-RAS-specific Monobody NS1 (Spencer-Smith et al, 2017).

The 58 kDa Megabodies $Mb_{NS1}^{cHopQ}$ described here are chimeric polypeptides concatenated from parts of a NS1, a synthetic binding protein (monobody) and parts of a scaffold protein connected by short polypeptide linkages according to FIG. 2. Here, the synthetic binding protein is the H-Ras and K-Ras binding monobody NS1 (Spencer-Smith et al, 2017) as depicted in SEQ ID NO:112. Monobodies are synthetic proteins, constructed on the basis of the fibronectin type Ill domain. Monobodies that bind with high affinity to a diverse array of targets, including the extracellular domain of receptors, kinases, steroid hormone receptors and modular protein domains, have been isolated (Koide, 2012). All parts were connected to each other from the amino to the carboxy terminus in the next given order by peptide bonds (SEQ ID NO:113-116) as depicted in 23: β-strand A of NS1 (1-13 of SEQ ID NO:112), a peptide linker of one or two amino acids with random composition, a C-terminal part of HopQ (residues 193-414 of SEQ ID NO:19), a peptide linker (SEQ ID NO:21) connecting the C-terminus and the N-terminus of HopQ to produce a circular permutant of the scaffold protein, an N-terminal part of HopQ (residues 15-186 of SEQ ID NO:19), a peptide linker of one or two amino acids with random composition, β-strands B to G of the NS1 monobody (residues 16-94 of SEQ ID NO:112), 6×His/EPEA tag.

To display and select functional Megabodies $Mb_{NS1}^{cHopQ}$ that differ in composition and length of the linkers connecting Monobody to scaffold on yeast, we used standard methods to construct a library of open reading frame that encode the various $Mb_{NS1}^{cHopQ}$ in fusion to a number of accessory peptides and proteins (SEQ ID NO:117-120): β-strand A of NS1 (1-13 of SEQ ID NO:112), a peptide linker of one or two amino acids with random composition, a C-terminal part of HopQ (residues 193-414 of SEQ ID NO:19), a peptide linker (SEQ ID NO:21) connecting the C-terminus and the N-terminus of HopQ to produce a circular permutant of the scaffold protein, an N-terminal part of HopQ (residues 15-186 of SEQ ID NO:19), a peptide linker of one or two amino acids with random composition, β-strands B to G of the NS1 monobody (residues 16-94 of SEQ ID NO: 112), a flexible $(GGSG)_n$ peptide linker, the Aga2p adhesion subunit of the yeast agglutinin protein Aga2p which attaches to the yeast cell wall through disulfide bonds to Aga1p protein, followed by an acyl carrier protein for the orthogonal fluorescent staining of the displayed fusion protein (Johnsson, 2005) and the myc tag. These open reading frames were put under the transcriptional control of galactose-inducible GAL1/10 promotor into the pCTCON2 vector (Chao, 2006) to construct a yeast display library encoding 184.000 different variants of the Megabody build from monobody NS1 and scaffold HopQ.

For in vitro selection, this library was introduced into yeast strain EBY100. Transformed cells were grown and induced overnight in a galactose-rich medium. Induced cells were orthogonally stained with CoA-488 (2 μM) using the SFP synthase (1 µM) and incubated with 100 nM of Dylight-647-labeled K-RAS. Next, these cells were washed and subjected to 2-parameter FACS analysis to identify yeast cells that display high levels of a particular Megabody (high CoA-488 fluorescence) and bind the antigen K-RAS (high Dylight-647 fluorescence). Cells that display high levels of K-RAS binding monobody were sorted and amplified in a glucose-rich medium to be subjected to following rounds of selection by yeast display and two-parameter FACS analysis.

After one round of selection, a representative number of highly fluorescent cells in the CoA-488 and Dylight-647 channels were grown as single colonies and subjected to DNA sequencing to determine the sequences of a representative number of peptide linkers connecting Monobody NS1 to scaffold protein. Three representative clones of 1-1 and 2-2 amino-acid short linker variants (Table 12) were confirmed to bind to 100 nM K-Ras in FACS experiments (FIG. 49). Presented high display levels and binding to the antigen, indicates that these Megabodies can be subjected to cellular secretion and displayed as functional K-RAS-binding chimeric proteins.

TABLE 12

The composition and the length of the yeast-display optimized linker peptides connecting scaffold protein to a Monobody.

| Megabody clone | Connection #1 | Connection #2 |
|---|---|---|
| MP1326_B6 | F | G |
| MP1326_C2 | Q | L |
| MP1326_E12 | A | V |
| MP1326_A3 | RP | SG |
| MP1326_A11 | VK | IR |
| MP1326_B12 | ES | TN |

Example 22. Design and Generation of Antigen-Binding Chimeric Proteins for Structural Analysis of Intractable Membrane-Bound Complexes Such as GPCRs, Ion Channels, and Tyrosine Receptor Kinases The application of the antigen-binding chimeric proteins as described herein, which specifically bind so called 'intractable' targets facilitate their refined structural analysis. As exemplified already in Examples 4-6, 58 kDa Megabodies were designed, produced and used in structural determination of GPCRs, G proteins, or ion channels. In Example 4, the Mb35 construct based on Nb35, which specifically binds the interface of the Gβ and Gα subunits of the β2 adrenergic receptor-Gs protein complex; in Example 5, the Mb80 construct based on Nb80, which specifically binds the human P2 adrenergic receptor; in Example 6, the Mb25 construct based on Nb25, which specifically binds the pentameric ligand-gated ion channel GABAA (Miller et al, 2017). In addition, $Mb_{Nb38}^{cHopQ}$, based on Nanobody Nb38 (SEQ ID NO:130) specifically binding the extracellular domain of the $GABA_A$ ion channel P1 subunit (Miller et al. 2018), was produced, and allowed to determine the high resolution structure of this membrane-bound protein. The $Mb_{Nb38}^{cHopQ}$ was generated as described in Example 6. Here, the immunoglobulin domain of Nb38 (SEQ ID NO:130), was connected with the scaffold protein cHopQ. All parts were connected to each other from the amino to the carboxy terminus in the next given order by peptide bonds (SEQ ID NO:131): β-strand A of the conserved N-terminus of the anti-GFP-Nanobody (1-13 of SEQ ID NO:1), a C-terminal part of HopQ (residues 192-414 of SEQ ID NO:19), a short peptide linker (SEQ ID NO:21) connecting the C-terminus and the N-terminus of HopQ to produce a circular permutant of the scaffold protein, an N-terminal part of HopQ (residues 14-186 of SEQ ID NO:19), β-strands B to G of Nb38 (residues 16-123 of SEQ ID NO:130), 6×His/EPEA tag.

Expression of the $Mb_{Nb38}^{cHopQ}$ construct in the E. coli and purification to homogeneity was done using nickel affinity chromatography, and size-exclusion chromatography to finally store the samples at 15 mg/mL at −80° C. Purified $Mb_{Nb38}^{cHopQ}$ (SEQ ID NO: 131) has been used to solve high-resolution cryo-EM structures of the full-length human α1β3γ2 $GABA_A$ receptor in lipid nanodiscs bound to the competitive antagonist bicuculline, the channel blocker picrotoxin, the agonist GABA and the classical benzodiazepines alprazolam (Xanax) and diazepam (Valium), respectively. Ionotropic signalling through type A γ-aminobutyric acid receptors ($GABA_A$Rs) drive fast inhibitory neurotransmission in the mammalian nervous system. Consequently, $GABA_A$Rs are crucial for virtually all aspects of brain function and represent important drug targets.

Alternatively, 100 kDa antigen-binding chimeric proteins are designed and produced based on said Nanobodies and applying the cYgjK scaffold, to facilitate structural analysis of such intractable membrane-bound complexes. This was demonstrated herein by grafting of Nb35, Nb80, Nb25 and Nb38 onto the circularly permutated version of YgjK. These Megabody clones were essentially generated as described in Example 8: $Mb_{Nb35}^{cYgjkE2}$ (SEQ ID NO:194): β-strand A of the anti-GFP-Nanobody (1-12 of SEQ ID NO:1), Tyr one amino acid linker, C-terminal part of YgjK (residues 464-760 of SEQ ID NO:38), a short peptide linker (SEQ ID NO:43) connecting the C-terminus and the N-terminus of YgjK to produce a circular permutant of the scaffold protein, an N-terminal part of YgjK (residues 1-461 of SEQ ID NO:38), Asp one amino acid linker, β-strands B to G of the Nb35 Nanobody (residues 17-128 of SEQ ID NO:24), 6×His/EPEA tag. A similar construction was followed to design and produce $Mb_{Nb80}^{cYgjkE2}$ (SEQ ID NO:195), but using β-strands B to G of the Nb80 Nanobody (residues 17-120 of SEQ ID NO:26); $Mb_{Nb25}^{cYgjkE2}$ (SEQ ID NO:196), but using β-strands B to G of the Nb25 Nanobody (residues 17-125 of SEQ ID NO:28); $Mb_{Nb38}^{cYgjkE2}$ (SEQ ID NO:197), but using β-strands B to G of the Nb38 Nanobody (residues 17-123 of SEQ ID NO:130).

In addition, $Mb_{Nb22}^{cYgjkE2}$ based on Nb22 Nanobody (SEQ ID NO:198) specifically binding to the tropomyosin-related kinase receptor B (TrkB) was produced to allow the determination of the high-resolution structure of this membrane-bound receptor. The $Mb_{Nb22}^{cY9kE2}$ was as well generated as described in Example 8: $Mb_{Nb22}^{cYgjkE2}$ (SEQ ID NO:199): β-strand A of the anti-GFP-Nanobody (1-12 of SEQ ID NO:1), Tyr one amino acid linker, C-terminal part of YgjK (residues 464-760 of SEQ ID NO:38), a short peptide linker (SEQ ID NO:43) connecting the C-terminus and the N-terminus of YgjK to produce a circular permutant of the scaffold protein, an N-terminal part of YgjK (residues 1-461 of SEQ ID NO:38), Asp one amino acid linker, β-strands B to G of the Nb22 Nanobody (residues 17-124 of SEQ ID NO:198), 6×His/EPEA tag. Periplasmic expression and purification to homogeneity of these Megabodies (SEQ ID NO: 194-195-196-197-199) was performed essentially as described in Example 8.

As an example, $Mb_{Nb22}^{cYgjkE2}$ (SEQ ID NO:199) has been used as a crystallization chaperone to crystallize the human brain-derived neurotrophic factor (BDNF) bound to the tropomyosin-related kinase receptor B (TrkB) and solved the high-resolution structure of the TrkB-BDNF-cYgjkE2Nb22 ternary complex by X-ray crystallography. BDNF is a neurotrophic factor that is involved in the development and functional modulation of circuits by promoting neuronal survival, synaptogenesis, synaptic transmission and synaptic plasticity. BDNF acts by binding to TrkB (Yoshii and Constantine-Paton, 2010).

Example 23: Design and Generation of Antigen-Binding Chimeric Proteins Capable of Specifically Binding the cHopQ Scaffold of cHopQ-Containing Antigen-Binding Chimeric Proteins, to Bind and Further Extend the Antigen-Binding Chimeric Protein Scaffold As schematically presented in FIG. 26, another antigen-binding chimeric protein has been generated, which comprises the cHopQ-specific Nanobody (Nb60), which is grafted onto a scaffold protein, according to the fusions in FIG. 2. The resulting composition of antigen-binding chimeric protein, or 'assembled antigen-binding chimeric proteins', or 'Polybody' or 'enlarged antigen-binding chimeric protein scaffold' allows to further increase the size of the antigen-binding chimeric proteins of the invention using this specific 'anti-Mb-scaffold Megabody'. Such 'Polybodies' may for instance comprise as a scaffold protein a mutated cHopQ protein, which does not bind the Nb60 cHopQ binding site, as to avoid self-interaction that would lead to aggregation. The scaffold used in the Polybody may also constitute a different scaffold, such as the cYgjK scaffold protein described herein, to avoid said self-binding. First, Nb60 (SEQ ID NO:132), which binds to the cHopQ, was generated and used for crystallization in the presence of $Mb_{Nb207}^{cHopQ}$ (SEQ ID NO:20). Based on the resolved crystal structure, the three residues (T289, N296 and E197) of cHopQ in the $Mb_{Nb207}^{cHopQ}$ were identified as main contributors for the Nb60-cHopQ interaction (FIG. 27). Moreover, a shorter version of the cHopQ-based Megabody design could be proposed, with a truncation of the circular permutation region (called cHopQ) which always appeared as a loop never fully visible in electron density of $Mb_{Nb207}^{cHopQ}$ crystal structures.

The $Mb_{Nb60}^{c7HopQ}$ is constituted of the following parts, connected to each other from the amino to the carboxy terminus in the next given order by peptide bonds: β-strand A of the anti-GFP Nanobody (1-13 of SEQ ID NO: 1), a C-terminal part of HopQ (residues 192-411 of SEQ ID NO:19), an N-terminal part of HopQ (residues 18-186 of SEQ ID NO:19), β-strands B to G of the cHopQ-binding Nanobody (residues 16-133 of SEQ ID NO:132), 6×His/EPEA tag. However, to generate a $Mb_{Nb60}^{c7H\ opQ}$ Megabody that binds to c/cHopQ-containing Megabodies but not to itself (auto-polymerization), two different mutants of the $Mb_{Nb60}^{c7HopQ}$ were used:

N277K, T270R ($Mb_{Nb60}^{c7HopQ}$ mut2, SEQ ID NO:133)

N277K, T270R, E197R ($Mb_{Nb60}^{cHopQ}$mut3, SEQ ID NO:134)

Those mutants of $Mb_{Nb60}^{c7HopQ}$ were expressed in the periplasm of *E. coli* as described in the Example 2, and purified to homogeneity. Next, Octet measurements (FIG. 29) provided evidence that those two $Mb_{Nb60}^{c7HopQ}$ mutant Megabodies can bind to Megabodies containing wild type cHopQ scaffold protein, using similar measurements as shown in FIG. 24. Biotinylated $Mb_{Nb207}^{cHopQ}$ (SEQ ID NO:20) was immobilized on Streptavidin biosensors. Different concentrations of Nb60 (SEQ ID NO:132), $Mb_{Nb60}^{c7HopQ}$mut 2 (SEQ ID NO:133) and $Mb_{Nb60}^{c7H\ opQ}$ mut 3 (SEQ ID NO:134) were examined against binding to immobilized $Mb_{Nb207}^{cHopQ}$. For Nb60 and two $Mb_{Nb60}^{c7H\ opQ}$ mutants binding to $Mb_{Nb207}^{cHopQ}$ was confirmed. Similar to the cHopQ-mutant-based approach, other scaffold proteins can be used to generate Polybodies or a composition of antigen-binding chimeric proteins. Accordingly, an alternative scaffold protein YgjK, a 86 kDA periplasmic protein of *E. coli* (PDB 3W7S, SEQ ID NO: 38) was used (FIG. 26, B). The $Mb_{Nb60}^{cYgjkE2}$ was generated as described in Example 8: $Mb_{Nb60}^{cYgjkE2}$ (SEQ ID NO:135): β-strand A of the anti-GFP-Nanobody (1-12 of SEQ ID NO:1), Tyr one amino acid linker, C-terminal part of YgjK (residues 464-760 of SEQ ID NO:38), a short peptide linker (SEQ ID NO:43) connecting the C-terminus and the N-terminus of YgjK to produce a circular permutant of the scaffold protein, an N-terminal part of YgjK (residues 1-461 of SEQ ID NO:38), Asp one amino acid linker, β-strands B to G of the Nb60 Nanobody (residues 17-133 of SEQ ID NO:132), 6×His/EPEA tag.

This Megabody was expressed and purified as described in Example 8. Next, binding of $Mb_{Nb60}^{cYgjkE2}$ to $Mb_{Nb207}^{cHopQ}$ was validated by Octet measurements as described above (FIG. 29).

Example 24: Design and Generation of Multimeric Antigen-Binding Chimeric Proteins Built from Dodecin Inserted into the First β-Strand AB-Connecting β-Turn of a GFP-Specific Nanobody by In Vitro Selection Herein we demonstrate how immunoglobulin domains can also by rigidly grafted onto Dodecin Rv1498A. This small flavoprotein from archaea *Mycobacterium tuberculosis* is an assemble of 12 monomers. It was shown that 12 copies of the monomer can self-assemble upon overexpression in *E. coli* to form highly thermostable Dodecin (Liu et al., 2011). In Dodecin, the N-terminus of each monomer is very close to the C-terminus of the same monomer. Accordingly, we constructed random libraries encoding rigid antigen-binding chimeric proteins that are built from a Nanobody that was grafted onto a Dodecin monomer in which two short peptides connect Nanobody to scaffold according to FIG. 2.

The 258 kDa $Mb_{Nb207}^{Dodecin}$ molecules described here, self-assemble from chimeric polypeptides built from parts of a single-domain immunoglobulin and parts of a scaffold protein directly linked according to FIG. 50. The immunoglobulin used is a GFP-binding Nanobody as depicted in SEQ ID NO:1. The scaffold protein used was the monomer of the Dodecin Rv1498A (GenBank Accession Number: 3205040, SEQ ID NO:192) of *M. tuberculosis*. All parts were connected to each other from the amino to the carboxy terminus in the next given order (SEQ ID NO:193): methionine encoded by the startcodon, β-strand A of the anti-GFP-Nanobody (residues 1-11 of SEQ ID NO:1), a peptide linker of one amino acids with random composition, the Dodecin Rv1498A protein (residues 5-66 of SEQ ID NO:192), a peptide linker of one or two amino acids with random composition, β-strands B to G of the GFP-binding Nanobody (residues 17-126 of SEQ ID NO:1), 6×His/EPEA tag. This antigen-binding chimeric protein self assembles into a Dodecin multimer that contains 12 copies of the Megabody (FIG. 50).

To select functional representatives of these antigen-binding chimeric proteins in which two short peptides connect the Nanobody to Dodecin (SEQ ID NO:193), we used standard methods to construct a library of open reading frames that encode the described above antigen-binding chimeric proteins (SEQ ID NO:193). These DNA fragments are cloned as HindIII-SpI fragments in the pMESP vector. This newly created plasmid was called pMESPDodecinXNb$_{GFP}$207. For selecting antigen-binding chimeric Mb$_{Nb207}$$^{Dodecin}$ proteins that can be recombinantly expressed and assembled correctly in vitro, libraries of antigen-binding chimeric proteins were constructed at the plasmid level. These libraries were used to transform E. coli cells. To identify chimeric proteins that assemble correctly as Dodecins, individual clones were expressed in E. coli and subjected to an ELISA as described in Example 7 to screen for clones that bind GFP (FIG. 51). Several clones that express an antigen-binding chimeric protein and bind GFP, were grown as single colonies and subjected to DNA sequencing to determine the sequences of the peptide linkers connecting Nanobody to a scaffold protein. This demonstrates that the antigen-binding chimeric proteins concatenated from parts of a single-domain immunoglobulin and the Dodecin linked by two short polypeptide linkages can be selected from libraries as functional antigen-binding chimeric proteins. Representative clones of 1-1 amino-acid short linker variants are given in Table 13. This indicates that these antigen-binding chimeric proteins built from Nanobody grafted onto monomer of the Dodecin Rv1498A can be functionally expressed in a E. coli.

TABLE 13

The composition of linker peptides connecting the Dodecin Rv1498A protein to Nanobody.

| Megabody clone | Connection #1 | Connection #2 |
|---|---|---|
| MP1462_G1 | L | P |
| MP1462_E2 | F | P |
| MP1462_B2 | V | P |
| MP1462_E3 | G | L |
| MP1462_D3 | D | T |
| MP1462_F1 | E | G |

Example 25: Design and Generation of a Megabody Built from the Disulfide-Bridged Homodimer Inserted into the First Exposed β-Turn of a GFP-Specific Nanobody by In Vitro Selection Herein it is described how an immunoglobulin domain can also by rigidly grafted onto a homodimer called 4QYB. This small protein of unknown function from *Burkholderia cenocepacia* J2315, is a homodimer where two monomers are connected by a single intermolecular disulfide bridge, as confirmed by the reported crystal structure of this protein (Halavaty et. al. Unpublished data, PDB code 4QYB). Additionally, the N-terminus of one monomer is very close to the C-terminus of the same monomer. Accordingly, we constructed random libraries encoding rigid antibody chimera that are built from a Nanobody that was grafted onto a 4QYB monomer in which two short peptides connect Nanobody to scaffold according to FIG. 2.

The 51 kDa homodimeric Mb$_{Nb207}$$^{4QYB}$ described here, self-assembles from chimeric polypeptides build from parts of a single-domain immunoglobulin and parts of a scaffold protein directly linked according to FIG. 52. The immunoglobulin used is a GFP-binding Nanobody as depicted in SEQ ID NO:1. The scaffold protein used was the monomer of the 4QYB from *B. cenocepacia* J2315 (PDB 4QYB, SEQ ID NO:200). All parts were connected to each other from the amino to the carboxy terminus in the next given order (SEQ ID NO:201-204): β-strand A of the anti-GFP-Nanobody (residues 1-12 of SEQ ID NO:1), a peptide linker of one or two amino acids with random composition, the 4QYB protein (residues 8-121 of SEQ ID NO:200), a peptide linker of one or two amino acids with random composition, β-strands B to G of the GFP-binding Nanobody (residues 16-126 of SEQ ID NO:1), 6×His/EPEA tag. This rigid antigen-binding chimeric protein self assembles into disulfide-bridged homodimer that contains 2 copies of the Nanobody (FIG. 52).

To select functional representatives of these antigen-binding chimeric proteins in which two short peptides connect the Nanobody to scaffold (SEQ ID NO:201-204) and express them in periplasm of E. coli, we used standard methods to construct a library of open reading frames that encode the described above antigen-binding chimeric proteins (SEQ ID NO:205-208): the PelB leader sequence that directs the secretion of the fusion protein to the periplasm of E. coli, β-strand A of the anti-GFP-Nanobody (residues 1-12 of SEQ ID NO:1), a peptide linker of one or two amino acids with random composition, the 4QYB protein (residues 8-121 of SEQ ID NO:200), a peptide linker of one or two amino acids with random composition, β-strands B to G of the GFP-binding Nanobody (residues 16-126 of SEQ ID NO:1), 6×His/EPEA tag. These DNA fragments are cloned as HindIII-SpI fragments in the pMESP vector. This newly created plasmid was called pMESP4QYBXXNb$_{GFP}$207.

For selecting Mb$_{Nb207}$$^{4QYB}$ proteins that can be recombinantly expressed and assembled correctly in vitro, libraries of antigen-binding chimeric proteins are constructed at the plasmid level. These libraries are used to transform E. coli cells, for the identification of correctly assembled homodimers. Individual clones were expressed in E. coli and subjected to an ELISA as described in Example 7 to screen for clones that bind GFP. Several clones that express an antigen-binding chimeric protein and bind GFP were grown as single colonies and subjected to DNA sequencing to determine the sequences of the peptide linkers connecting Nanobody to a scaffold protein.

```
Sequence list
>SEQ ID NO: 1: Nb_GFP207 GFP-specific Nanobody = Nb207

>SEQ ID NO: 2: bacteriophage of P. Aeruginosa PP7 coat protein monomer

>SEQ ID NO: 3-6: Mb_Nb207^cPP7x2L dimer
(Nb_GFP207 sequences in bold, circular permutation linker in italics, PP7 sequences underlined, (X)_1-2 is
a short peptide linker of variable length (1 or 2 amino acids), tags in small letters)
MQVQLVESGGGLVQATRTLTEIQSTADRQIFEEKVGPLVGRLRLTASLRQNGAKTAYRVNLKLDQADVV

DCSTSVCGELPKVRYTQVWSHDVTIVANSTEASRKSLYDLTKSLVATSQVEDLVVNLVPLGR(X)_1-2GSK

TIVLSVGEATRTLTEIQSTADRQIFEEKVGPLVGRLRLTASLRQNGAKTAYRVNLKLDQADVVDCSTSVC
```

GELPKVRYTQVWSHDVTIVANSTEASRKSLYDLTKSLVATSQVEDLVVNLVPLGR(X)₁₋₂GSKTIVLSGSL

RLSCAASGRTFSTAAMGWFRQAPGKERDFVAGIYWTVGSTYYADSAKGRFTISRDNAKNTVYLQMD

SLKPEDTAVYYCAARRRGFTLAPTRANEYDYWGQGTQVTVSShhhhhhepea

>SEQ ID NO: 7: cAb$_{Lys}$3 hen egg-white lysozyme specific Nanobody (PDB 1MEL)

>SEQ ID NO: 8: bacteriophage of *Escherichia coli* coat protein monomer (PDB 2MS2)

>SEQ ID NO: 9: Mb$_{cAbLys3}^{cMS2x2}$L dimer
(Nb$_{GFP}$207 strand A and cAb$_{Lys}$3, sequences in bold, *circular permutation linker in italics*, MS2 sequences underlined, tags in small letters)
MQVQLQESGGGLVXX GDVTVAPSNFANGVAEWISSNSRSQAYKVTCSVRQSSAQNRKYTIKVEVPKV

ATQTVGGVELPVAAWRSYLNMELTIPIFATNSDCELIVKAMQGLLKDGNPIPSAIAANSGIYASNFTQFVL

VDNGGTGDVTVAPSNFANGVAEWISSNSRSQAYKVTCSVRQSSAQNRKYTIKVEVPKVATQTVGGVEL

PVAAWRSYLNMELTIPIFATNSDCELIVKAMQGLLKDGNPIPSAIAANSGIYASNFTQFVLVDNGXXSLRL

SCAASGYTIGPYCMGWFRQAPGKEREGVAAINMGGGITYYADSVKGRFTISQDNAKNTVYLLMNSLE

PEDTAIYYCAADSTIYASYYECGHGLSTGGYGYDSWGQGTQVTVSShhhhhhepea

>SEQ ID NO: 10-13: Mb$_{cAbLys3}^{cMS2x2}$L dimer
MQVQLQESGGGLV(X)₁₋₂GDVTVAPSNFANGVAEWISSNSRSQAYKVTCSVRQSSAQNRKYTIKVEVP

KVATQTVGGVELPVAAWRSYLNMELTIPIFATNSDCELIVKAMQGLLKDGNPIPSAIAANSGIYASNFTQF

VLVDNGGTGDVTVAPSNFANGVAEWISSNSRSQAYKVTCSVRQSSAQNRKYTIKVEVPKVATQTVGGV

ELPVAAWRSYLNMELTIPIFATNSDCELIVKAMQGLLKDGNPIPSAIAANSGIYASNFTQFVLVDNG(X)₁₋₂

SLRLSCAASGYTIGPYCMGWFRQAPGKEREGVAAINMGGGITYYADSVKGRFTISQDNAKNTVYLLM

NSLEPEDTAIYYCAADSTIYASYYECGHGLSTGGYGYDSWGQGTQVTVSShhhhhhepea

>SEQ ID NO: 14: N2b$_{Nb207}^{cAbLys3}$L Nano2body
(Nb$_{GFP}$207 β-strand A double underlined, Nb$_{GFP}$207 in bold, and cAb$_{Lys}$3 sequences are underlined)
<u><u>QVQLVESGGGLVQAG</u></u>(X)₃GVQLVESGGGLVQAGGS<u>LRLSCAASGRTFSTAAMGWFRQAPGKERDF</u>

<u>VAGIYWTVGSTYYADSAKGRFTISRDNAKNTVYLQMDSLKPEDTAVYYCAARRRGFTLAPTRANEYD</u>

<u>YWGQ</u>(X)₂<u>GSLRLSCAASGYTIGPYCMGWFRQAPGKEREGVAAINMGGGITYYADSVKGRFTISQDNAK</u>

<u>NTVYLLMNSLEPEDTAIYYCAADSTIYASYYECGHGLSTGGYGYDSWGQGTQVTVSS</u>(X)₃GQGTQVTV

SShhhhhhepea

>SEQ ID NO: 15: PelB_N2b$_{Nb207}^{cAbLys3}$L_tags, amberstopcodon(*)_protein3 Nano2body
(the PelB leader sequence, Nb$_{GFP}$207 β-strand A double underlined Nb$_{GFP}$207 in bold, cAb$_{Lys}$3 sequences are underlined, tags in small letters, amberstopcodon as *, *protein3 in italic*)
MKYLLPTAAAGLLLLAAQPAMA<u><u>QVQLVESGGGLVQAG</u></u>XXXGVQLVESGGGLVQAGGS<u>LRLSCAASGR</u>

<u>TFSTAAMGWFRQAPGKERDFVAGIYWTVGSTYYADSAKGRFTISRDNAKNTVYLQMDSLKPEDTAVY</u>

<u>YCAARRRGFTLAPTRANEYDYWGQ</u>XX<u>GSLRLSCAASGYTIGPYCMGWFRQAPGKEREGVAAINMGG</u>

<u>GITYYADSVKGRFTISQDNAKNTVYLLMNSLEPEDTAIYYCAADSTIYASYYECGHGLSTGGYGYDSWG</u>

<u>QGTQVTVSS</u>XXXGQGTQVTVSShhhhhhepea*ypydvpdygS*TVESCLAKPHTENSFTNVWKDDKTLDRYA*

*NYEGCLWNATGVVVCTGDETQCYGTWVPIGLAIPENEGGGSEGGGSEGGGSEGGGTKPPEYGDTPIP*

*GYTYINPLDGTYPPGTEQNPANPNPSLEESQPLNTFMFQNNRFRNRQGALTVYTGTVTQGTDPVKTYY*

*QYTPVSSKAMYDAYWNGKFRDCAFHSGFNEDPFVCEYQGQSSDLPQPPVNAGGGSGGGSGGGSEG*

*GGSEGGGSEGGGSEGGGSEGGGSGGGSGSGDFDYEKMANANKGAMTENADENALQSDAKGKLDS*

*VATDYGAAIDGFIGDVSGLANGNGATGDFAGSNSQMAQVGDGDNSPLMNNFRQYLPSLPQSVECRPY*

*VFGAGKPYEFSIDCDKINLFRGVFAFLLYVATFMYVFSTFANILRNKES*

>SEQ ID NO: 16: DsbA_N2b$_{Nb207}^{cAbLys3}$L_tags, amberstopcodon(*)_protein3 Nano2body
(the DsbA leader sequence, Nb$_{GFP}$207 β-strand A double underlined Nb$_{GFP}$207 in bold, cAb$_{Lys}$3 sequences are underlined, tags in small letters, amberstopcodon as *, *protein3 in italic*)
MKKIWLALAGLVLAFSASA<u><u>QVQLVESGGGLVQAG</u></u>XXXGVQLVESGGGLVQAGGS<u>LRLSCAASGRTFS</u>

<u>TAAMGWFRQAPGKERDFVAGIYWTVGSTYYADSAKGRFTISRDNAKNTVYLQMDSLKPEDTAVYYC</u>

AARRRGFTLAPTRANEYDYWGQXX<u>GSLRLSCAASGYTIGPYCMGWFRQAPGKEREGVAAINMGGGIT</u>

<u>YYADSVKGRFTISQDNAKNTVYLLMNSLEPEDTAIYYCAADSTIYASYYECGHGLSTGGYGYDSWGQG</u>

<u>TQVTVSS</u>XXXGQGTQVTVSShhhhhepea*ypydvpdygS*TVESCLAKPHTENSFTNVWKDDKTLDRYANY*

*EGCLWNATGVVVCTGDETQCYGTWPIGLAIPENEGGGSEGGGSEGGGSEGGGTKPPEYGDTPIPGY*

*TYINPLDGTYPPGTEQNPANPNPSLEESQPLNTFMFQNNRFRNRQGALTVYTGTVTQGTDPVKTYYQY*

*TPVSSKAMYDAYWNGKFRDCAFHSGFNEDPFVCEYQGQSSDLPQPPVNAGGGSGGGSGGGSEGGG*

*SEGGGSEGGGSEGGGSEGGGSGGGSGSGDFDYEKMANANKGAMTENADENALQSDAKGKLDSVAT*

*DYGAAIDGFIGDVSGLANGNGATGDFAGSNSQMAQVGDGDNSPLMNNFRQYLPSLPQSVECRPYVFG*

*AGKPYEFSIDCDKINLFRGVFAFLLYVATFMYVFSTFANILRNKES*

>SEQ ID NO: 17: Nb<sub>FEDF</sub>9 the lectin domain of the F18 fimbrial adhesin FedF specific Nanobody (PDB 4W6Y)

>SEQ ID NO: 18: N2b<sub>Nb207</sub><sup>NbFEDF9</sup>L Nano2body
(Nb<sub>GFP</sub>207 β-strand A double underlined, Nb<sub>GFP</sub>207 in bold, and <u>Nb<sub>FedF</sub>9 sequences are underlined</u>)
<u>QVQLVESGGGLVQAG</u>XXX<u>G</u>VQLVESGGGLVQAGGSLRLSCAASGRTFSTAAMGWFRQAPGKERDF

VAGIYWTVGSTYYADSAKGRFTISRDNAKNTVYLQMDSLKPEDTAVYYCAARRGFTLAPTRANEYD

YWGQXX<u>GSLRLSCAASGYTYSSNCMAWFRQVPGKEREGVASINTRGGITYYADSVKGRFTISRDNAK</u>

<u>NTVSLQMNSLKPEDTATYYCAAVREATYSDNRCSVRSYTYDYWGQGTQVTVSS</u>XXXGQGTQVTVSSh hhhhhepea >SEQ ID NO: 19: *Helicobacter pylori* strain G27 HopQ adhesin domain protein (PDB 5LP2)

>SEQ ID NO: 20: Mb<sub>Nb207</sub><sup>cHopQ</sup>
(Nb<sub>GFP</sub>207 sequences in bold, *circular permutation linker in italics*, <u>HopQ sequences underlined</u>)
QVQLVESGGGLVQ<u>TKTTTSVIDTTNDAQNLLTQAQTIVNTLKDYCPILIAKSSSNGGTNNANTPSWQTA</u>

<u>GGGKNSCATFGAEFSAASDMINNAQKIVQETQQLSANQPKNITQPHNLNLNSPSSLTALAQKMLKNAQS</u>

<u>QAEILKLANQVESDFNKLSSGHLKDYIGKCDASAISSANMTMQNQKNNWGNGCAGVEETQSLLKTSAA</u>

<u>DFNNQTPQINQAQNLANTLIQELGNNPFR</u>*asgggsggggsg*<u>KLSDTYEQLSRLLTNDNGTNSKTSAQAINQA</u>

<u>VNNLNERAKTLAGGTTNSPAYQATLLALRSVLGLWNSMGYAVICGGYTKSPGENNQKDFHYTDENGN</u>

<u>GTTINCGGSTNSNGTHSYNGTNTLKADKNVSLSIEQYEKIHEAYQILSKALKQAGLAPLNSKGEKLEAHV</u>

<u>TTSKY</u>GSLRLSCAASGRTFSTAAMGWFRQAPGKERDFVAGIYWTVGSTYYADSAKGRFTISRDNAKN

TVYLQMDSLKPEDTAVYYCAARRGFTLAPTRANEYDYWGQGTQVTVSShhhhhepea

>SEQ ID NO: 21: cHopQ circular permutation linker peptide

>SEQ ID NO: 22: Mb<sub>Nb207</sub><sup>cHopQ</sup>_Aga2p_ACP protein sequence
(appS4 leader sequence, Megabody cHopQNb<sub>GFP</sub>207 depicted in bold, flexible (GGGS)<sub>n</sub> polypeptide linker, <u>Aga2p protein sequence underlined</u>, <u>ACP sequence double underlined</u>, cMyc Tag)
MRFPSIFTAVVFAASSALAAPANTTAEDETAQIPAEAVIGYLGLEGDSDVAALPLSDSTNNGSLSTNTTIA

SIAAKEEGVQLDKREAEAQVQLVESGGGLVQTKTTTSVIDTTNDAQNLLTQAQTIVNTLKDYCPILIAKS

SSSNGGTNNANTPSWQTAGGGKNSCATFGAEFSAASDMINNAQKIVQETQQLSANQPKNITQPHNL

NLNSPSSLTALAQKMLKNAQSQAEILKLANQVESDFNKLSSGHLKDYIGKCDASAISSANMTMQNQK

NNWGNGCAGVEETQSLLKTSAADFNNQTPQINQAQNLANTLIQELGNNPFRASGGGSGGGGSGKLS

DTYEQLSRLLTNDNGTNSKTSAQAINQAVNNLNERAKTLAGGTTNSPAYQATLLALRSVLGLWNSMG

YAVICGGYTKSPGENNQKDFHYTDENGNGTTINCGGSTNSNGTHSYNGTNTLKADKNVSLSIEQYEKI

HEAYQILSKALKQAGLAPLNSKGEKLEAHVTTSKYGSLRLSCAASGRTFSTAAMGWFRQAPGKERD

FVAGIYWTVGSTYYADSAKGRFTISRDNAKNTVYLQMDSLKPEDTAVYYCAARRGFTLAPTRANEY

DYWGQGTQVTVSS*lgggsgggsgggsgggsgggsgggsgggsgggsgggs*<u>QELTTICEQIPSPTLESTPYSLSTTTILA</u>

<u>NGKAMQGVFEYYKSVTFVSNCGSHPSTTSKGSPINTQYVFKd</u>nssts<u>MSTIEERVKKIIGEQLGVKQEEVT</u>

<u>NNASFVEDLGADSLDTVELVMALEEEFDTEIPDEEAEKITTVQAAIDYINGHQA</u>seqkliseedl

>SEQ ID NO: 23: DsbA-Mb$_{Nb207}^{cHopQ}$

>SEQ ID NO: 24: Nb35 Gβ/Gα subunit of the β2 adrenergic receptor-Gs protein complex-specific Nanobody >SEQ ID NO: 25: Mb$_{Nb35}^{cHopQ}$
(Nb$_{GFP}$207 β-strand A, *circular permutation linker in italics*, HopQ sequences underlined, Nb35 β-strands B to G in bold, 6xHis tag, EPEA tag)
QVQLVESGGGLVQTKTTTSVIDTTNDAQNLLTQAQTIVNTLKDYCPILIAKSSSSNGGTNNANTPSWQTA

GGGKNSCATFGAEFSSAASDMINNAQKIVQETQQLSANQPKNITQPHNLNLSPSSLTALAQKMLKNAQS

QAEILKLANQVESDFNKLSSGHLKDYIGKCDASAISSANMTMQNQKNNWGNGCAGVEETQSLLKTSAA

DFNNQTPQINQAQNLANTLIQELGNNPFR*asgggsggggsg*KLSDTYEQLSRLLTNDNGTNSKTSAQAINQA

VNNLNERAKTLAGGTTNSPAYQATLLALRSVLGLWNSMGYAVICGGYTKSPGENNQKDFHYTDENGN

GTTINCGGSTNSNGTHSYNGTNTLKADKNVSLSIEQYEKIHEAYQILSKALKQAGLAPLNSKGEKLEAHV

TTSKYGSLRLSCAASGFTFSNYKMNWVRQAPGKGLEWVSDISQSGASISYTGSVKGRFTISRDNAKN

TLYLQMNSLKPEDTAVYYCARCPAPFTRDCFDVTSTTYAYRGQGTQVTVSShhhhhhepea

>SEQ ID NO: 26: Nb80 β2 adrenergic receptor-specific Nanobody

>SEQ ID NO: 27: Mb$_{Nb80}^{cHopQ}$
(Nb$_{GFP}$207 β-strand A, *circular permutation linker in italics*, HopQ sequences underlined, Nb80 β-strands B to G in bold, 6xHis tag, EPEA tag)
QVQLVESGGGLVQTKTTTSVIDTTNDAQNLLTQAQTIVNTLKDYCPILIAKSSSSNGGTNNANTPSWQTA

GGGKNSCATFGAEFSSAASDMINNAQKIVQETQQLSANQPKNITQPHNLNLSPSSLTALAQKMLKNAQS

QAEILKLANQVESDFNKLSSGHLKDYIGKCDASAISSANMTMQNQKNNWGNGCAGVEETQSLLKTSAA

DFNNQTPQINQAQNLANTLIQELGNNPFR*asgggsggggsg*KLSDTYEQLSRLLTNDNGTNSKTSAQAINQA

VNNLNERAKTLAGGTTNSPAYQATLLALRSVLGLWNSMGYAVICGGYTKSPGENNQKDFHYTDENGN

GTTINCGGSTNSNGTHSYNGTNTLKADKNVSLSIEQYEKIHEAYQILSKALKQAGLAPLNSKGEKLEAHV

TTSKYGSLRLSCAASGSIFSINTMGWYRQAPGKQRELVAAIHSGGSTNYANSVKGRFTISRDNAANTV

YLQMNSLKPEDTAVYYCNVKDYGAVLYEYDYWGQGTQVTVSShhhhhhepea

>SEQ ID NO: 28: Nb25 GABA$_A$-specific Nanobody

>SEQ ID NO: 29: Mb$_{Nb25}^{cHopQ}$
(Nb$_{GFP}$207 β-strand A, *circular permutation linker in italics*, HopQ sequences underlined, Nb25 β-strands B to G in bold, 6xHis tag, EPEA tag)
QVQLVESGGGLVQTKTTTSVIDTTNDAQNLLTQAQTIVNTLKDYCPILIAKSSSSNGGTNNANTPSWQTA

GGGKNSCATFGAEFSSAASDMINNAQKIVQETQQLSANQPKNITQPHNLNLSPSSLTALAQKMLKNAQS

QAEILKLANQVESDFNKLSSGHLKDYIGKCDASAISSANMTMQNQKNNWGNGCAGVEETQSLLKTSAA

DFNNQTPQINQAQNLANTLIQELGNNPFR*asgggsggggsg*KLSDTYEQLSRLLTNDNGTNSKTSAQAINQA

VNNLNERAKTLAGGTTNSPAYQATLLALRSVLGLWNSMGYAVICGGYTKSPGENNQKDFHYTDENGN

GTTINCGGSTNSNGTHSYNGTNTLKADKNVSLSIEQYEKIHEAYQILSKALKQAGLAPLNSKGEKLEAHV

TTSKYGSLRLSCAASGHTFNYPIMGWFRQAPGKEREFVGAISWSGGSTSYADSVKDRFTISRDNAKN

TVYLEMNNLKPEDTAVYYCAAKGRYSGGLYYPTNYDYWGQGTQVTVSShhhhhhepea

>SEQ ID NO: 30-33: Mb$_{Nb207}^{cHopQ}$randomlinkers
(Nb$_{GFP}$207 sequences in bold, (X)$_{1-2}$ is a short peptide linker of variable length (1 or 2 amino acids) and mixed composition, *circular permutation linker in italics*, HopQ sequences underlined)
QVQLVESGGGLV(X)$_{1-2}$KTTTSVIDTTNDAQNLLTQAQTIVNTLKDYCPILIAKSSSSNGGTNNANTPSWQ

TAGGGKNSCATFGAEFSSAASDMINNAQKIVQETQQLSANQPKNITQPHNLNLSPSSLTALAQKMLKNA

QSQAEILKLANQVESDFNKLSSGHLKDYIGKCDASAISSANMTMQNQKNNWGNGCAGVEETQSLLKTS

AADFNNQTPQINQAQNLANTLIQELGNNPFR*asgggsggggsg*KLSDTYEQLSRLLTNDNGTNSKTSAQAIN

QAVNNLNERAKTLAGGTTNSPAYQATLLALRSVLGLWNSMGYAVICGGYTKSPGENNQKDFHYTDEN

GNGTTINCGGSTNSNGTHSYNGTNTLKADKNVSLSIEQYEKIHEAYQILSKALKQAGLAPLNSKGEKLEA

HVTTSK(X)₁₋₂SLRLSCAASGRTFSTAAMGWFRQAPGKERDFVAGIYWTVGSTYYADSAKGRFTISRD

NAKNTVYLQMDSLKPEDTAVYYCAARRRGFTLAPTRANEYDYWGQGTQVTVSShhhhhhepea

\>SEQ ID NO: 34-37: Mb<sub>Nb207</sub><sup>cHopQ</sup>randomlinkers_Aga2p_ACP protein sequence
(appS4 leader sequence, Megabody chopQNb<sub>GFP</sub>207randomlinkers depicted in bold, (X)₁₋₂ is a short peptide linker of variable length (1 or 2 amino acids) and mixed composition, *flexible (GGGS)<sub>n</sub> polypeptide linker in italics*, Aga2p protein sequence underlined, ACP sequence double underlined, cMyc Tag)
MRFPSIFTAVVFAASSALAAPANTTAEDETAQIPAEAVIGYLGLEGDSDVAALPLSDSTNNGSLSTNTTIA

SIAAKEEGVQLDKREAEAQVQLVESGGGLV(X)₁₋₂KTTTSVIDTTNDAQNLLTQAQTIVNTLKDYCPILIA

KSSSSNGGTNNANTPSWQTAGGGKNSCATFGAEFSAASDMINNAQKIVQETQQLSANQPKNITQPH

NLNLNSPSSLTALAQKMLKNAQSQAEILKLANQVESDFNKLSSGHLKDYIGKCDASAISSANMTMQN

QKNNWGNGCAGVEETQSLLKTSAADFNNQTPQINQAQNLANTLIQELGNNPFRASGGGSGGGGSG

KLSDTYEQLSRLLTNDNGTNSKTSAQAINQAVNNLNERAKTLAGGTTNSPAYQATLLALRSVLGLWN

SMGYAVICGGYTKSPGENNQKDFHYTDENGNGTTINCGGSTNSNGTHSYNGTNTLKADKNVSLSIEQ

YEKIHEAYQILSKALKQAGLAPLNSKGEKLEAHVTTSK(X)₁₋₂SLRLSCAASGRTFSTAAMGWFRQAP

GKERDFVAGIYWTVGSTYYADSAKGRFTISRDNAKNTVYLQMDSLKPEDTAVYYCAARRRGFTLAPT

RANEYDYWGQGTQVTVSS*lgggsggggsggggsggggsggggsggggsggggs*QELTTICEQIPSPTLESTPYSLS TTTILANGKAMQGVFEYYKSVTFVSNCGSHPSTTKGSPINTQYVFKdnsstsMSTIEERVKKIIGEQLGVK QEEVTNNASFVEDLGADSLDTVELVMALEEEFDTEIPDEEAEKITTVQAAIDYINGHQAseqkliseedl \>SEQ ID NO: 38: *E. coli* Ygjk protein (PDB 3WFS)

\>SEQ ID NO: 39-42: Mb<sub>Nb207</sub><sup>cYgjkQ</sup>randomlinkers
(Nb<sub>GFP</sub>207 sequences in bold, *circular permutation linker in italics*, Ygjk sequences underlined, (X)₁₋₂ is a short peptide linker of variable length (1 or 2 amino acids) and mixed composition, 6xHis & EPEA tags)
QVQLVESGGGLV(X)₁₋₂KEETQSGLNNYARVVEKGQYDSLEIPAQVAASWESGRDDAAVFGFIDKEQLD

KYVANGGKRSDWTVKFAENRSQDGTLLGYSLLQESVDQASYMYSDNHYLAEMATILGKPEEAKRYRQ

LAQQLADYINTCMFDPTTQFYYDVRIEDKPLANGCAGKPIVERGKGPEGWSPLFNGAATQANADAVVK

VMLDPKEFNTFVPLGTAALTNPAFGADIYWRGRVWVDQFWFGLKGMERYGYRDDALKLADTFFRHAK

GLTADGPIQENYNPLTGAQQGAPNFSWSAAHLYMLYNDFFRKQ*asgggsggggsggggsg*NADNYKNVINR

TGAPQYMKDYDYDDHQRFNPFFDLGAWHGHLLPDGPNTMGGFPGVALLTEEYINFMASNFDRLTVWQ

DGKKVDFTLEAYSIPGALVQKLTAKDVQVEMTLRFATPRTSLLETKITSNKPLDLVWDGELLEKLEAKEG

KPLSDKTIAGEYPDYQRKISATRDGLKVTFGKVRATWDLLTSGESEYQVHKSLPVQTEINGNRFTSKAHI

NGSTTLYTTYSHLLTAQEVSKEQMQIRDILARPAFYLTASQQRWEEYLKKGLTNPDATPEQTRVAVKAIE

TLNGNWRSPGGAVKFNTVTPSVTGRWFSGNQTWPWDTWKQAFAMAHFNPDIAKENIRAVFSWQIQP

GDSVRPQDVGFVPDLIAWNLSPERGGDGGNWNERNTKPSLAAWSVMEVYNVTQDKTWVAEMYPKLV

AYHDWWLRNRDHNGNGVPEYGATRDKAHNTESGEMLFTVKK(X)₁₋₂SLRLSCAASGRTFSTAAMGWF

RQAPGKERDFVAGIYWTVGSTYYADSAKGRFTISRDNAKNTVYLQMDSLKPEDTAVYYCAARRRGFT

LAPTRANEYDYWGQGTQVTVSShhhhhhepea

\>SEQ ID NO: 43: cYgjk circular permutation linker peptide

\>SEQ ID NO: 44-47: Mb<sub>Nb207</sub><sup>cYgjk</sup>randomlinkers_Aga2p_ACP protein sequence
(appS4 leader sequence, Megabody cYgjkQNb<sub>GFP</sub>207randomlinkers library depicted in bold, flexible (GGGS)<sub>n</sub> polypeptide linker, Aga2p protein sequence underlined, ACP sequence double underlined, cMyc Tag)
MRFPSIFTAVVFAASSALAAPANTTAEDETAQIPAEAVIGYLGLEGDSDVAALPLSDSTNNGSLSTNTTIA

SIAAKEEGVQLDKREAEAQVQLVESGGGLV(X)₁₋₂KEETQSGLNNYARVVEKGQYDSLEIPAQVAASW

ESGRDDAAVFGFIDKEQLDKYVANGGKRSDWTVKFAENRSQDGTLLGYSLLQESVDQASYMYSDNH

YLAEMATILGKPEEAKRYRQLAQQLADYINTCMFDPTTQFYYDVRIEDKPLANGCAGKPIVERGKGPE

GWSPLFNGAATQANADAVVKVMLDPKEFNTFVPLGTAALTNPAFGADIYWRGRVWVDQFWFGLKG

MERYGYRDDALKLADTFFRHAKGLTADGPIQENYNPLTGAQQGAPNFSWSAAHLYMLYNDFFRKQA

*SGGGSGGGGSGGGGS*QNADNYKNVINRTGAPQYMKDYDYDDHQRFNPFFDLGAWHGHLLPDGPN

TMGGFPGVALLTEEYINFMASNFDRLTVWQDGKKVDFTLEAYSIPGALVQKLTAKDVQVEMTLRFATP

RTSLLETKITSNKPLDLVWDGELLEKLEAKEGKPLSDKTIAGEYPDYQRKISATRDGLKVTFGKVRAT

WDLLTSGESEYQVHKSLPVQTEINGNRFTSKAHINGSTTLYTTYSHLLTAQEVSKEQMQIRDILARPAF

YLTASQQRWEEYLKKGLTNPDATPEQTRVAVKAIETLNGNWRSPGGAVKFNTVTPSVTGRWFSGNQ

TWPWDTWKQAFAMAHFNPDIAKENIRAVFSWQIQPGDSVRPQDVGFVPDLIAWNLSPERGGDGGNW

NERNTKPSLAAWSVMEVYNVTQDKTWVAEMYPKLVAYHDWWLRNRDHNGNGVPEYGATRDKAHN

TESGEMLFTVKK(X)$_{1-2}$SLRLSCAASGRTFSTAAMGWFRQAPGKERDFVAGIYWTVGSTYYADSAKG

RFTISRDNAKNTVYLQMDSLKPEDTAVYYCAARRRGFTLAPTRANEYDYWGQGTQVTVSS*lgggsgggg*

*sggggsggggsggggsggggsggggs*QELTTICEQIPSPTLESTPYSLSTTTILANGKAMQGVFEYYKSVTFVSN

CGSHPSTTSKGSPINTQYVFK*dnssts*MSTIEERVKKIIGEQLGVKQEEVTNNASFVEDLGADSLDTVELVM

ALEEEFDTEIPDEEAEKITTVQAAIDYINGHQA*seqkliseedl*

>SEQ ID NO: 48: Mb$_{Nb207}$$^{cHopQ}$C$_{357}$-C$_{425}$
(Nb$_{GFP}$207 sequences in bold, *circular permutation linker in italics*, HopQ sequences underlined,
*Cysteines connecting Nanobody to scaffold in bold italics* )
QVQLVESGGGLVQTKTTTSVIDTTNDAQNLLTQAQTIVNTLKDYCPILIAKSSSNGGTNNANTPSWQTA

GGGKNSCATFGAEFSAASDMINNAQKIVQETQQLSANQPKNITQPHNLNLSPSSLTALAQKMLKNAQS

QAEILKLANQVESDFNKLSSGHLKDYIGKCDASAISSANMTMQNQKNNWGNGCAGVEETQSLLKTSAA

DFNNQTPQINQAQNLANTLIQELGNNPFR*asgggagggga*gKLSDTYEQLSRLLTNDNGTNSKTSAQINAQ

VNNLNERAKTLAGGTTNSPAYQATLLALRSVLGLWNSMGYAVICGGYTKSPGENNQKDFHYTDENGN

GTTINCGGSTCSNGTHSYNGTNTLKADKNVSLSIEQYEKIHEAYQILSKALKQAGLAPLNSKGEKLEAHV

TTSKY**GSL*C*LSCAASGRTFSTAAMGWFRQAPGKERDFVAGIYWTVGSTYYADSAKGRFTISRDNAKN**

TVYLQMDSLKPEDTAVYYCAARRRGFTLAPTRANEYDYWGQGTQVTVSS*hhhhh*hepea

>SEQ ID NO: 49: Mb$_{Nb207}$$^{cHopQ}$C$_{358}$-C$_{488}$
(Nb$_{GFP}$207 sequences in bold, *circular permutation linker in italics*, HopQ sequences underlined,
*Cysteines connecting Nanobody to scaffold in bold italics* )
QVQLVESGGGLVQTKTTTSVIDTTNDAQNLLTQAQTIVNTLKDYCPILIAKSSSNGGTNNANTPSWQTA

GGGKNSCATFGAEFSAASDMINNAQKIVQETQQLSANQPKNITQPHNLNLSPSSLTALAQKMLKNAQS

QAEILKLANQVESDFNKLSSGHLKDYIGKCDASAISSANMTMQNQKNNWGNGCAGVEETQSLLKTSAA

DFNNQTPQINQAQNLANTLIQELGNNPFR*asggggggggg*KLSDTYEQLSRLLTNDNGTNSKTSAQAINQA

VNNLNERAKTLAGGTTNSPAYQATLLALRSVLGLWNSMGYAVICGGYTKSPGENNQKDFHYTDENGN

GTTINCGGSTNCNGTHSYNGTNTLKADKNVSLSIEQYEKIHEAYQILSKALKQAGLAPLNSKGEKLEAHV

TTSKYGSLRLSCAASGRTFSTAAMGWFRQAPGKERDFVAGIYWTVGSTYYADSAKGRFTISRDNAKN

TVYLQMDSLKPEDTAVYYCAARRRGFTLAPTRANEYDYWGQGTQVTVSS*hhhhh*hepea

>SEQ ID NO: 50: Mb$_{Nb207}$$^{cHopQ}$C$_{359}$-C$_{490}$
(Nb$_{GFP}$207 sequences in bold, *circular permutation linker in italics*, HopQ sequences underlined,
*Cysteines connecting Nanobody to scaffold in bold italics* )
QVQLVESGGGLVQTKTTTSVIDTTNDAQNLLTQAQTIVNTLKDYCPILIAKSSSNGGTNNANTPSWQTA

GGGKNSCATFGAEFSAASDMINNAQKIVQETQQLSANQPKNITQPHNLNLSPSSLTALAQKMLKNAQS

QAEILKLANQVESDFNKLSSGHLKDYIGKCDASAISSANMTMQNQKNNWGNGCAGVEETQSLLKTSAA

DFNNQTPQINQAQNLANTLIQELGNNPFR*asgggsggggsg*KLSDTYEQLSRLLTNDNGTNSKTSAQAINQA

VNNLNERAKTLAGGTTNSPAYQATLLALRSVLGLWNSMGYAVICGGYTKSPGENNQKDFHYTDENGN

GTTINCGGSTNSCGTHSYNGTNTLKADKNVSLSIEQYEKIHEAYQILSKALKQAGLAPLNSKGEKLEAHV

TTSKYGSLRLSCAASGRTFSTAAMGWFRQAPGKERDFVAGIYWTVGSTYYADSAKGRFTISRDNAKN

TVYLQMCSLKPEDTAVYYCAARRRGFTLAPTRANEYDYWGQGTQVTVSShhhhhepea

>SEQ ID NO: 51: Mb$_{Nb207}^{cHopQ}$C$_{15}$-C$_{534}$
(Nb$_{GFP}$207 sequences in bold, *circular permutation linker in italics*, HopQ sequences underlined)
QVQLVESGGGLVQ<u>C</u><u>TTTSVIDTTNDAQNLLTQAQTIVNTLKDYCPILIAKSSSSNGGTNNANTPSWQTA</u>

<u>GGGKNSCATFGAEFSAASDMINNAQKIVQETQQLSANQPKNITQPHNLNLNSPSSLTALAQKMLKNAQS</u>

<u>QAEILKLANQVESDFNKLSSGHLKDYIGKCDASAISSANMTMQNQKNNWGNGCAGVEETQSLLKTSAA</u>

<u>DFNNQTPQINQAQNLANTLIQELGNNPFR</u>*sgggsgggsg*KLSDTYEQLSRLLTNDNGTNSKTSAQAINQA

VNNLNERAKTLAGGTTNSPAYQATLLALRSVLGLWNSMGYAVICGGYTKSPGENNQKDFHYTDENGN

GTTINCGGSTNSNGTHSYNGTNTLKADKNVSLSIEQYEKIHEAYQILSKALKQAGLAPLNSKGEKLEAHV

TTSKYGSLRLSCAASGRTFSTAAMGWFRQAPGKERDFVAGIYWTVGSTYYADSAKGRFTISRDNAKN

TVYLQMDSLKPEDTAVYYCAARRRGFTLAPTRANEYDYWGQGTQVTVSSGChhhhhepea

>SEQ ID NO: 52: *P. aeruginosa* Azurin (PDB 2TSA) M121A mutant protein

>SEQ ID NO: 53-60: Mb$_{Nb207}^{AzurinQ}$randomlinkers
(Nb$_{GFP}$207 sequences in bold, <u>Azurin sequences underlined</u>, (X)$_{1-2}$ is a short peptide linker of variable length (1 or 2 amino acids) and mixed composition)
QVQLVESGGGLV(X)$_{1-2}$<u>CSVDIQGNDQMQFNTNAITV</u>(X)$_{1-2}$SLRLSCAASGRTFSTAAMGWFRQAPGK

ERDFVAGIYWTVGSTYYADSAKGRFTISRDNAKNTVYLQMDSLKPEDTAVYYCAARRRGFTLAPTRA

NEYDYWGQGTQVTVSS(X)$_{1-2}$<u>VNLSHPGNLPKNVMGHNWWLSTAADMQGVVTDGMASGLDKDYLKPD</u>

<u>DSRVIAHTKLIGSGEKDSVTFDVSKLKEGEQYMFFCTFPGHSALAKGTLTLK</u>hhhhhepea

>SEQ ID NO: 61-68: Mb$_{Nb207}^{AzurinQ}$connection library_Aga2p_ACP protein sequence
(appS4 leader sequence, Megabody AzurinNb$_{GFP}$207_randomlinkers library depicted in bold, flexible (GGGS)$_n$ polypeptide linker, <u>Aga2p protein sequence underlined</u>, <u><u>ACP sequence double underlined</u></u>, cMyc Tag)
MRFPSIFTAVVFAASSALAAPANTTAEDETAQIPAEAVIGYLGLEGDSDVAALPLSDSTNNGSLSTNTTIA

SIAAKEEGVQLDKREAEAQVQLVESGGGLV(X)$_{1-2}$CSVDIQGNDQMQFNTNAITV(X)$_{1-2}$

SLRLSCAASGRTFS

TAAMGWFRQAPGKERDFVAGIYWTVGSTYYADSAKGRFTISRDNAKNTVYLQMDSLKPEDTAVYYC

AARRRGFTLAPTRANEYDYWGQGTQVTVSS(X)$_{1-2}$

VNLSHPGNLPKNVMGHNWVLSTAADMQGVVTDG

MASGLDKDYLKPDDSRVIAHTKLIGSGEKDSVTFDVSKLKEGEQYMFFCTFPGHSALAKGTLTLKs*lgg*

*gsggggsggggsggggsggggsggggsggggsggggs*<u>QELTTICEQIPSPTLESTPYSLSTTTILANGKAMQGVFEYYKSVT</u>

<u>FVSNCGSHPSTTSKGSPINTQYVFK</u>dnssts<u><u>MSTIEERVKKIIGEQLGVKQEEVTNNASFVEDLGADSLDTV</u></u>

<u><u>ELVMALEEEFDTEIPDEEAEKITTVQAAIDYINGHQA</u></u>seqkliseedl

>SEQ ID NO: 69: *Bacteroides thetaiotaomicron* SusB protein (PDB3wfa)

>SEQ ID NO: 70-77: Mb$_{Nb207}^{SusB}$randomlinkers Megabody library protein sequences
(Nb$_{GFP}$207 sequences in bold, (X)$_{1-2}$ is a short peptide linker of variable length (1 or 2 amino acids) and mixed composition, <u>susB sequences underlined</u>)
QVQLVESGGGLVQA(X)$_{1-2}$<u>MQQKLTSPDNNLVMTFQVDSKGAPTYELTYKNKVVIKPSTLGLELKKEDN</u>

<u>TRTDFDWDRRDLTKLDS</u>(X)$_{1-2}$GGSLRLSCAASGRTFSTAAMGWFRQAPGKERDFVAGIYWTVGST

YYADSAKGRFTISRDNAKNTVYLQMDSLKPEDTAVYYCAARRRGFTLAPTRANEYDYWGQGTQVTV

S(X)$_{1-2}$<u>FEVKDTQTATFDETWQPVWGEEKEIRNHYNELAVTLYQPMNDRSIVIRFRLENDGLGFRYEFPQ</u>

<u>QKSLNYFVIKEEHSQFGMNGDHIAFWIPGDYDTQEYDYTISRLSEIRGLMKEAITPNSSQTPFSQTGVQT</u>

<u>ALMMKTDDGLYINLHEAALVDYSCMHLNLDDKNMVFESWLTPDAKGDKGYMQTPCNTPWRTIIVSDDA</u>

<u>RNILASRITLNLNEPCKIADAASWVKPVKYIGVWWDMITGKGSWAYTDELTSVKLGETDYSKTKPNGKH</u>

<u>SANTANVKRYIDFAAAHGFDAVLVEGWNEGWEDWFGNSKDYVFDFVTPYPDFDVKEIHRYAARKGIKM</u>

<u>MMHHETSASVRNYERHMDKAYQFMADNGYNSVKSGYVGNIIPRGEHHYGQWMNNHYLYAVKKAADY</u>

KIMVNAHEATRPTGICRTYPNLIGNESARGTEYESFGGNKVYHTTILPFTRLVGGPMDYTPGIFETHCNK

MNPANNSQVRSTIARQLALYVTMYSPLQMAADIPENYERFMDAFQFIKDVALDWDETNYLEAEPGEYITI

ARKAKDTDDWYVGCTAGENGHTSKLVFDFLTPGKQYIATVYADAKDADWKENPQAYTIKKGILTNKSKL

NLHAANGGGYAISIKEVKDKSEAKGLKRLhhhhhhepea

>SEQ ID NO: 78-85: homo-dimeric Megabody Mb<sub>Nb207</sub><sup>SusB</sup>randomlinkers_Aga2p_ACP protein sequences
(appS4 leader sequence, susBNb<sub>GFP</sub>207randomlinkers Megabody library depicted in bold, flexible (GGGS)<sub>n</sub> polypeptide linker, Aga2p protein sequence underlined, ACP sequence double underlined, cMyc Tag)
MRFPSIFTAVVFAASSALAAPANTTAEDETAQIPAEAVIGYLGLEGDSDVAALPLSDSTNNGSLSTNTTIA SIAAKEEGVQLDKREAEAQVQLVESGGGLVQAs(X)<sub>1-2</sub>MQQKLTSPDNNLVMTFQVDSKGAPTYELTY

KNKVVIKPSTLGLELKKEDNTRTDFDWVDRRDLTKLDS(X)<sub>1-2</sub>GGSLRLSCAASGRTFSTAAMGWFRQ

APGKERDFVAGIYWTVGSTYYADSAKGRFTISRDNAKNTVYLQMDSLKPEDTAVYYCAARRRGFTLA

PTRANEYDYWGQGTQVTVS(X)<sub>1-2</sub>FEVKDTQTATFDETWQPVWGEEKEIRNHYNELAVTLYQPMNDR

SIVIRFRLFNDGLGFRYEFPQQKSLNYFVIKEEHSQFGMNGDHIAFWIPGDYDTQEYDYTISRLSEIRGL

MKEAITPNSSQTPFSQTGVQTALMMKTDDGLYINLHEAALVDYSCMHLNLDDKNMVFESWLTPDAKG

DKGYMQTPCNTPWRTIIVSDDARNILASRITLNLNEPCKIADAASWVKPVKYIGVWWDMITGKGSWAY

TDELTSVKLGETDYSKTKPNGKHSANTANVKRYIDFAAAHGFDAVLVEGWNEGWEDWFGNSKDYVF

DFVTPYPDFDVKEIHRYAARKGIKMMMHHETSASVRNYERHMDKAYQFMADNGYNSVKSGYVGNIIP

RGEHHYGQWMNNHYLYAVKKAADYKIMVNAHEATRPTGICRTYPNLIGNESARGTEYESFGGNKVYH

TTILPFTRLVGGPMDYTPGIFETHCNKMNPANNSQVRSTIARQLALYVTMYSPLQMAADIPENYERFM

DAFQFIKDVALDWDETNYLEAEPGEYITIARKAKDTDDWYVGCTAGENGHTSKLVFDFLTPGKQYIAT

VYADAKDADWKENPQAYTIKKGILTNKSKLNLHAANGGGYAISIKEVKDKSEAKGLKRL_slgggsggggsg_

_gggsgggsgggsgggsgggsgggs_<u>QELTTICEQIPSPTLESTPYSLSTTTILANGKAMQGVFEYYKSVTFVSNCG</u>

<u>SHPSTTSKGSPINTQYVFK</u>dnssts<u><u>MSTIEERVKKIIGEQLGVKQEEVTNNASFVEDLGADSLDTVELVMAL</u></u>

<u><u>EEEFDTEIPDEEAEKITTVQAAIDYINGHQA</u></u>seqkliseedl

>SEQ ID NO: 86: *E. coli* Acyl carrier protein (PDB1T8K)

>SEQ ID NO: 87-90: Nanotool Mb<sub>Nb207</sub><sup>ACP</sup>randomlinkers
(Nb<sub>GFP</sub>207 sequences in bold, (X)<sub>1-2</sub> is a short peptide linker of variable length (1 or 2 amino acids) and mixed composition, ACP sequences underlined)
QVQLVESGGGL(X)<sub>1-2</sub><u>TIEERVKKIIGEQLGVKQEEVTNNASFVEDLGADSLDTVELVMALEEEFDTEIPD</u>

<u>EEAEKITTVQAAIDYINGHQ</u>(X)<sub>1-2</sub>SLRLSCAASGRTFSTAAMGWFRQAPGKERDFVAGIYWTVGSTYY

ADSAKGRFTISRDNAKNTVYLQMDSLKPEDTAVYYCAARRRGFTLAPTRANEYDYWGQGTQVTVSSh hhhhhepea

>SEQ ID NO: 91-94: Nanotool Mb<sub>Nb207</sub><sup>ACP</sup>randomlinkers_Aga2p protein sequences
(appS4 leader sequence, Nanotool ACPNb<sub>GFP</sub>207 randomlinkers, (X)<sub>1-2</sub> is a short peptide linker of variable length (1 or 2 amino acids) and mixed composition, flexible (GGGS)<sub>n</sub> polypeptide linker, Aga2p protein sequence underlined, <u>cMyc Tag double underlined</u>)
MRFPSIFTAVVFAASSALAAPANTTAEDETAQIPAEAVIGYLGLEGDSDVAALPLSDSTNNGSLSTNTTIA SIAAKEEGVQLDKREAEAQVQLVESGGGL(X)<sub>1-2</sub>TIEERVKKIIGEQLGVKQEEVTNNASFVEDLGADSL

DTVELVMALEEEFDTEIPDEEAEKITTVQAAIDYINGHQ(X)<sub>1-2</sub>SLRLSCAASGRTFSTAAMGWFRQAPG

KERDFVAGIYWTVGSTYYADSAKGRFTISRDNAKNTVYLQMDSLKPEDTAVYYCAARRRGFTLAPTR

ANEYDYWGQGTQVTVSSlgggsggggsgggsgggsgggsgggsgggsgggs<u>QELTTICEQIPSPTLESTPYSLST</u>

<u>TTILANGKAMQGVFEYYKSVTFVSNCGSHPSTTSKGSPINTQYVFK</u>dnsst<u><u>seqkliseedl</u></u>

>SEQ ID NO: 95: Mb<sub>Nb207</sub><sup>cHopQ</sup>MP1251_A7
(Nb<sub>GFP</sub>207 β-strand A, *circular permutation linker in italics*, HopQ sequences underlined, β-strands A to G of Nanobody MP1251_A7)
<u>QVQLVESGGGLVQTKTTTSVIDTTNDAQNLLTQAQTIVNTLKDYCPILIAKSSSNNGGTNNANTPSWQTA</u>

<u>GGGKNSCATFGAEFSAASDMINNAQKIVQETQQLSANQPKNITQPHNLNLSPSSLTALAQKMLKNAQS</u>

-continued

QAEILKLANQVESDFNKLSSGHLKDYIGKCDASAISSANMTMQNQKNNWGNGCAGVEETQSLLKTSAA

DFNNQTPQINQAQNLANTLIQELGNNPFR*asgggsggggsg*KLSDTYEQLSRLLTNDNGTNSKTSAQAINQA

VNNLNERAKTLAGGTTNSPAYQATLLALRSVLGLWNSMGYAVICGGYTKSPGENNQKDFHYTDENGN

GTTINCGGSTNSNGTHSYNGTNTLKADKNVSLSIEQYEKIHEAYQILSKALKQAGLAPLNSKGEKLEAHV

TTSKYGSLRLSCAASGRTFSVSNMGWFRQAPGKERVFVAAIGWTTGSTYYADSVKGRFTISRDNTKN

TVYLQMNSLKPEDTAVYRCAARRRGYSRVPMTPDEYEYWGQGTQVTVSS

>SEQ ID NO: 96: Mb$_{Nb207}^{cHopQ}$MP1252_D10
(Nb$_{GFP}$207 β-strand A, *circular permutation linker in italics*, HopQ sequences underlined, β-strands A to G of Nanobody MP1252_D10)

>SEQ ID NO: 97: Mb$_{Nb207}^{cHopQ}$MP1251_D10
(Nb$_{GFP}$207 β-strand A, *circular permutation linker in italics*, HopQ sequences underlined, β-strands A to G of Nanobody MP1251_D10)

>SEQ ID NO: 98: Mb$_{Nb207}^{cHopQ}$MP1251_A10
(Nb$_{GFP}$207 β-strand A, *circular permutation linker in italics*, HopQ sequences underlined, β-strands A to G of Nanobody MP1251_A10)

>SEQ ID NO: 99: Mb$_{Nb207}^{cHopQ}$MP1251_D4
(Nb$_{GFP}$207 β-strand A, *circular permutation linker in italics*, HopQ sequences underlined, β-strands A to G of Nanobody MP1251_D4)

>SEQ ID NO: 100: Mb$_{Nb207}^{cHopQ}$MP1252_C10
(Nb$_{GFP}$207 β-strand A, *circular permutation linker in italics*, HopQ sequences underlined, β-strands A to G of Nanobody MP1252_C10)

>SEQ ID NO: 101: Mb$_{Nb207}^{cHopQ}$MP1251_H6
(Nb$_{GFP}$207 β-strand A, *circular permutation linker in italics*, HopQ sequences underlined, β-strands A to G of Nanobody MP1251_H6)

>SEQ ID NO: 102: Mb$_{Nb207}^{cHopQ}$MP1251_A5
(Nb$_{GFP}$207 β-strand A, *circular permutation linker in italics*, HopQ sequences underlined, β-strands A to G of Nanobody MP1251_A5)

>SEQ ID NO: 103: Mb$_{Nb207}^{cHopQ}$MP1263_C9
(Nb$_{GFP}$207 β-strand A, *circular permutation linker in italics*, HopQ sequences underlined, β-strands A to G of Nanobody MP1263_C9)

>SEQ ID NO: 104-107: Mb$_{Nb207}^{cHopQ}$_βturnCC'_randomlinkers protein sequences
(Nb$_{GFP}$207 β-strands A to C, $(X)_{1-2}$ is a short peptide linker of variable length (1 or 2 amino acids) and mixed composition, *circular permutation linker in italics*, HopQ sequences underlined, Nb207 β-strands C' to G in bold, 6xHis tag, EPEA tag)
QVQLVESGGGLVQAGGSLRLSCAASGRTFSTAAMGWFRQ$(X)_{1-2}$KTTTSVIDTTNDAQNLLTQAQTIVN

TLKDYCPILIAKSSSSNGGTNNANTPSWQTAGGGKNSCATFGAEFSAASDMINNAQKIVQETQQLSANQ

PKNITQPHNLNLNSPSSLTALAQKMLKNAQSQAEILKLANQVESDFNKLSSGHLKDYIGKCDASAISSAN

MTMQNQKNNWGNGCAGVEETQSLLKTSAADFNNQTPQINQAQNLANTLIQELGNNPFR*asgggsggggsg*

KLSDTYEQLSRLLTNDNGTNSKTSAQAINQAVNNLNERAKTLAGGTTNSPAYQATLLALRSVLGLWNSM

GYAVICGGYTKSPGENNQKDFHYTDENGNGTTINCGGSTNSNGTHSYNGTNTLKADKNVSLSIEQYEKI

HEAYQILSKALKQAGLAPLNSKGEKLEAHVTTSKY$(X)_{1-2}$DFVAGIYWTVGSTYYADSAKGRFTISRDNA

KNTVYLQMDSLKPEDTAVYYCAARRRGFTLAPTRANEYDYWGQGTQVTVSShhhhhhepea

>SEQ ID NO: 108-111: Mb$_{Nb207}^{cHopQ}$_βturnCC'_randomlinkers_Aga2p_ACP protein sequences
(appS4 leader sequence, Megabody cHopQNb$_{GFP}$207_βturnCC'_randomlinkers library depicted in bold, flexible $(GGGS)_n$ polypeptide linker, Aga2p protein sequence underlined, ACP sequence double underlined, cMyc Tag)
MRFPSIFTAVVFAASSALAAPANTTAEDETAQIPAEAVIGYLGLEGDSDVAALPLSDSTNNGSLSTNTTIA

SIAAKEEGVQLDKREAEAQVQLVESGGGLVQAGGSLRLSCAASGRTFSTAAMGWFRQ$(X)_{1-2}$KTTTSV

IDTTNDAQNLLTQAQTIVNTLKDYCPILIAKSSSSNGGTNNANTPSWQTAGGGKNSCATFGAEFSAAS

DMINNAQKIVQETQQLSANQPKNITQPHNLNLNSPSSLTALAQKMLKNAQSQAEILKLANQVESDFNK

LSSGHLKDYIGKCDASAISSANMTMQNQKNNWGNGCAGVEETQSLLKTSAADFNNQTPQINQAQNL

**ANTLIQELGNNPFR*asgggsggggsg*KLSDTYEQLSRLLTNDNGTNSKTSAQAINQAVNNLNERAKTLA**

GGTTNSPAYQATLLALRSVLGLWNSMGYAVICGGYTKSPGENNQKDFHYTDENGNGTTINCGGSTNS

NGTHSYNGTNTLKADKNVSLSIEQYEKIHEAYQILSKALKQAGLAPLNSKGEKLEAHVTTSKY(X)$_{1-2}$DF

VAGIYWTVGSTYYADSAKGRFTISRDNAKNTVYLQMDSLKPEDTAVYYCAARRRGFTLAPTRANEYD

YWGQGTQVTVSS*lgggsggggsggggsggggsggggsggggsggggsggggs*QELTTICEQIPSPTLESTPYSLSTTTILAN GKAMQGVFEYYKSVTFVSNCGSHPSTTSKGSPINTQYVFK dnssts MSTIEERVKKIIGEQLGVKQEEVTN NASFVEDLGADSLDTVELVMALEEEFDTEIPDEEAEKITTVQAAIDYINGHQA seqkliseedl >SEQ ID NO: 112: *Deinococcus radiodurans* Monobody NS1 (from PDB5E59)

>SEQ ID NO: 113-116: Mb$_{NS1}^{cHopQ}$_randomlinkers
(NS1 β-strand A, (X)$_{1-2}$ is a short peptide linker of variable length (1 or 2 amino acids) and mixed composition, HopQ sequences underlined, *circular permutation linker in italics*, NS1 β-strands B to G in bold, 6xHis tag, EPEA tag)
SSVPTKLEVVAAT(X)$_{1-2}$KTTTSVIDTTNDAQNLLTQAQTIVNTLKDYCPILIAKSSSSNGGTNNANTPSWQ

TAGGGKNSCATFGAEFSAASDMINNAQKIVQETQQLSANQPKNITQPHNLNLNSPSSLTALAQKMLKNA

QSQAEILKLANQVESDFNKLSSGHLKDYIGKCDASAISSANMTMQNQKNNWGNGCAGVEETQSLLKTS

AADFNNQTPQINQAQNLANTLIQELGNNPFRa*sgggsggggsg*KLSDTYEQLSRLLTNDNGTNSKTSAQAIN

QAVNNLNERAKTLAGGTTNSPAYQATLLALRSVLGLWNSMGYAVICGGYTKSPGENNQKDFHYTDEN

GNGTTINCGGSTNSNGTHSYNGTNTLKADKNVSLSIEQYEKIHEAYQILSKALKQAGLAPLNSKGEKLEA

HVTTSKY(X)$_{1-2}$SLLISWDAPAVTVDYYVITYGETGGNSPVQKFEVPGSKSTATISGLKPGVDYTITVYA

WGWHGQVYYYMGSPISINYRThhhhhhepea

>SEQ ID NO: 117-120: Mb$_{NS1}^{cHopQ}$_randomlinkers_Aga2p_ACP protein sequences
(appS4 leader sequence, cHopQNS1_randomlinkers Megabody library depicted in bold, flexible (GGGS)$_n$ polypeptide linker, Aga2p protein sequence underlined, ACP sequence double underlined, cMyc Tag)
MRFPSIFTAVVFAASSALAAPANTTAEDETAQIPAEAVIGYLGLEGDSDVAALPLSDSTNNGSLSTNTTIA SIAAKEEGVQLDKREAEASSVPTKLEVVAAT(X)$_{1-2}$KTTTSVIDTTNDAQNLLTQAQTIVNTLKDYCPILIA

KSSSSNGGTNNANTPSWQTAGGGKNSCATFGAEFSAASDMINNAQKIVQETQQLSANQPKNITQPH

NLNLNSPSSLTALAQKMLKNAQSQAEILKLANQVESDFNKLSSGHLKDYIGKCDASAISSANMTMQN

QKNNWGNGCAGVEETQSLLKTSAADFNNQTPQINQAQNLANTLIQELGNNPFRASGGGSGGGGSG

KLSDTYEQLSRLLTNDNGTNSKTSAQAINQAVNNLNERAKTLAGGTTNSPAYQATLLALRSVLGLWN

SMGYAVICGGYTKSPGENNQKDFHYTDENGNGTTINCGGSTNSNGTHSYNGTNTLKADKNVSLSIEQ

YEKIHEAYQILSKALKQAGLAPLNSKGEKLEAHVTTSKY(X)$_{1-2}$SLLISWDAPAVTVDYYVITYGETGGN

SPVQKFEVPGSKSTATISGLKPGVDYTITVYAWGWHGQVYYYMGSPISINYRT*slgggsggggsggggsgggg*

*sgggggsggggsggggs*QELTTICEQIPSPTLESTPYSLSTTTILANGKAMQGVFEYYKSVTFVSNCGSHPSTTS

KGSPINTQYVFKdnssts<u><u>MSTIEERVKKIIGEQLGVKQEEVTNNASFVEDLGADSLDTVELVMALEEEFDTEI</u></u>

<u><u>PDEEAEKITTVQAAIDYINGHQA</u></u>seqkliseedl

>SEQ ID NO: 121: Nb$_{GFP}$207 (DNA) = Nb207

>SEQ ID NO: 122: TU89 Forward primer (SapI digestion site) (DNA)

>SEQ ID NO: 123: EP230 Reverse primer (SapI digestion site) (DNA)

>SEQ ID NO: 124: TU64 primer (DNA)

>SEQ ID NO: 125: TU65 primer (DNA)

>SEQ ID NO: 126: TU131 primer (DNA)

>SEQ ID NO: 127: TU132 primer (DNA)

>SEQ ID NO: 128: TU133 primer (DNA)

>SEQ ID NO: 129: TU134 primer (DNA)

>SEQ ID NO: 130: Nb38 GABA$_A$-specific Nanobody

>SEQ ID NO: 131: Mb$_{Nb38}^{cHopQ}$
(Nb$_{GFP}$207 β-strand A, *circular permutation linker in italics*, HopQ sequences underlined, Nb38 β-strands B to G in bold, 6xHis tag, EPEA tag)
QVQLVESGGGLVQTKTTTSVIDTTNDAQNLLTQAQTIVNTLKDYCPILIAKSSSNGGTNNANTPSWQTA

GGGKNSCATFGAEFSAASDMINNAQKIVQETQQLSANQPKNITQPHNLNSPSSLTALAQKMLKNAQS

QAEILKLANQVESDFNKLSSGHLKDYIGKCDASAISSANMTMQNQKNNWGNGCAGVEETQSLLKTSAA

DFNNQTPQINQAQNLANTLIQELGNNPFR*asgggsggggsg*KLSDTYEQLSRLTNDNGTNSKTSAQAINQA

VNNLNERAKTLAGGTTNSPAYQATLLALRSVLGLWNSMGYAVICGGYTKSPGENNQKDFHYTDENGN

GTTINCGGSTNSNGTHSYNGTNTLKADKNVSLSIEQYEKIHEAYQILSKALKQAGLAPLNSKGEKLEAHV

TTSKYGSLRLSCAASGRTFTTYIMAWFRQAPGKEREFLAAMDQGRIQYYGDSVRGRFTISRDYAKNS

VDLQLDGLRPEDTAVYYCAAGAGFWGLRTASSYHYWGQGTQVTVSShhhhhhepea

>SEQ ID NO: 132: Nb60 HopQ-specific Nanobody

>SEQ ID NO: 133: Mb$_{Nb60}^{c7HopQ}$ N277K T270R
(Nb$_{GFP}$207 β-strand A, HopQ sequences underlined, *N277K T270R* mutations, Nb60 β-strands B to G in bold, 6xHis tag, EPEA tag)
QVQLVESGGGLVQTKTTTSVIDTTNDAQNLLTQAQTIVNTLKDYCPILIAKSSSNGGTNNANTPSWQTA

GGGKNSCATFGAEFSAASDMINNAQKIVQETQQLSANQPKNITQPHNLNSPSSLTALAQKMLKNAQS

QAEILKLANQVESDFNKLSSGHLKDYIGKCDASAISSANMTMQNQKNNWGNGCAGVEETQSLLKTSAA

DFNNQTPQINQAQNLANTLIQELGNNTYEQLSRLLTNDNGTNSKTSAQAINQAVNNLNEAK*R*LAGGTT

*K*SPAYQATLLALRSVLGLWNSMGYAVICGGYTKSPGENNQKDFHYTDENGNGTTINCGGSTNSNGTH

SYNGTNTLKADKNVSLSIEQYEKIHEAYQILSKALKQAGLAPLNSKGEKLEAHVTTSKYGSLRLSCAASG

FTFSRYAMSWVRQAPGKGPEWVSAINSPGGSTSYADSVKGRFTISRDNAKNTLYLQMNSLKPDDTAV

YYCAKYERATEWGHTIVAVTPLLDGVHDYWGQGTQVTVSShhhhhhepea

>SEQ ID NO: 134: Mb$_{Nb60}^{c7HopQ}$ N277K T270R E197R
(Nb$_{GFP}$207 β-strand A, HopQ sequences underlined, *N277K T270R E197R* mutations, Nb60 β-strands B to G in bold, 6xHis tag, EPEA tag)
QVQLVESGGGLVQTKTTTSVIDTTNDAQNLLTQAQTIVNTLKDYCPILIAKSSSNGGTNNANTPSWQTA

GGGKNSCATFGAEFSAASDMINNAQKIVQETQQLSANQPKNITQPHNLNSPSSLTALAQKMLKNAQS

QAEILKLANQVESDFNKLSSGHLKDYIGKCDASAISSANMTMQNQKNNWGNGCAGVE*R*TQSLLKTSAA

DFNNQTPQINQAQNLANTLIQELGNNTYEQLSRLLTNDNGTNSKTSAQAINQAVNNLNERAK*R*LAGTT

*K*SPAYQATLLALRSVLGLWNSMGYAVICGGYTKSPGENNQKDFHYTDENGNGTTINCGGSTNSNGTH

SYNGTNTLKADKNVSLSIEQYEKIHEAYQILSKALKQAGLAPLNSKGEKLEAHVTTSKYGSLRLSCAASG

FTFSRYAMSWVRQAPGKGPEWVSAINSPGGSTSYADSVKGRFTISRDNAKNTLYLQMNSLKPDDTAV

YYCAKYERATEWGHTIVAVTPLLDGVHDYWGQGTQVTVSShhhhhhepea

>SEQ ID NO: 135: Mb$_{Nb60}^{cYgjkQE2}$
(Nb$_{GFP}$207 sequences in bold, *circular permutation linker in italics*, Ygjk sequences underlined, one amino acid linkers, , 6xHis & EPEA tags)
QVQLVESGGGLVyKEETQSGLNNYARVVEKGQYDSLEIPAQVAASWESGRDDAAVFGFIDKEQLDKYV

ANGGKRSDWTVKFAENRSQDGTLLGYSLLQESVDQASYMYSDNHYLAEMATILGKPEEAKRYRQLAQ

QLADYINTCMFDPTTQFYYDVRIEDKPLANGCAGKPIVERGKGPEGWSPLFNGAATQANADAVVKVML

DPKEFNTFVPLGTAALTNPAFGADIYWRGRVWVDQFWFGLKGMERYGYRDDALKLADTFFRHAKGLT

ADGPIQENYNPLTGAQQGAPNFSWSAAHLYMLYNDFFRKQ*asgggsggggsggggsg*NADNYKNVINRTGA

PQYMKDYDYDDHQRFNPFFDLGAWHGHLLPDGPNTMGGFPGVALLTEEYINFMASNFDRLTVWQDG

KKVDFTLEAYSIPGALVQKLTAKDVQVEMTLRFATPRTSLLETKITSNKPLDLVWDGELLEKLEAKEGKPL

SDKTIAGEYPDYQRKISATRDGLKVTFGKVRATWDLLTSGESEYQVHKSLPVQTEINGNRFTSKAHINGS

TTLYTTYSHLLTAQEVSKEQMQIRDILARPAFYLTASQQRWEEYLKKGLTNPDATPEQTRVAVKAIETLN

GNWRSPGGAVKFNTVTPSVTGRWFSGNQTWPWDTWKQAFAMAHFNPDIAKENIRAVFSWQIQPGDS

VRPQDVGFVPDLIAWNLSPERGGDGGNWNERNTKPSLAAWSVMEVYNVTQDKTWVAEMYPKLVAYH

DWWLRNRDHNGNGVPEYGATRDKAHNTESGEMLFTVKK<u>D</u> SLRLSCAASGFTFSRYAMSWVRQAPG

KGPEWVSAINSPGGSTSYADSVKGRFTISRDNAKNTLYLQMNSLKPDDTAVYYCAKYERATEWGHTI

VAVTPLLDGVHDYWGQGTQVTVSShhhhhhepea

>SEQ ID NO: 136: Mb<sub>Nb207</sub><sup>c7HopQ</sup>
(<u>Nb<sub>GFP</sub>207 β-strand A</u>, <u>HopQ sequences underlined</u>, Nb<sub>GFP</sub>207 β-strands B to G in bold, 6xHis tag, EPEA tag)
<u>QVQLVESGGGLVQ</u>TKTTTSVIDTTNDAQNLLTQAQTIVNTLKDYCPILIAKSSSNGGTNNANTPSWQTA

GGGKNSCATFGAEFSAASDMINNAQKIVQETQQLSANQPKNITQPHNLNLNSPSSLTALAQKMLKNAQS

QAEILKLANQVESDFNKLSSGHLKDYIGKCDASAISSANMTMQNQKNNWGNGCAGVEETQSLLKTSAA

DFNNQTPQINQAQNLANTLIQELGNNTYEQLSRLLTNDNGTNSKTSAQAINQAVNNLNERAKTLAGGTT

NSPAYQATLLALRSVLGLWNSMGYAVICGGYTKSPGENNQKDFHYTDENGNGTTINCGGSTNSNGTH

SYNGTNTLKADKNVSLSIEQYEKIHEAYQILSKALKQAGLAPLNSKGEKLEAHVTTSKYGSLRLSCAASG

RTFSTAAMGWFRQAPGKERDFVAGIYWTVGSTYYADSAKGRFTISRDNAKNTVYLQMDSLKPEDTAV

YYCAARRRGFTLAPTRANEYDYWGQGTQVTVSShhhhhhepea

>SEQ ID NO: 137-140: Mb<sub>Nb207</sub><sup>c7HopQ</sup> A5, A12, B7, and G10, resp.

>SEQ ID NO: 141: Mb<sub>Nb207</sub><sup>cYgiK</sup>E2
(Nb<sub>GFP</sub>207 sequences in bold, *Y* short peptide linker, <u>YgiK sequences underlined</u>, *circular permutation linker in italics*, <u>YgiK sequences underlined</u>, *D* short peptide linker, 6xHis & EPEA tags)
QVQLVESGGGLV*Y* <u>KEETQSGLNNYARVVEKGQYDSLEIPAQVAASWESGRDDAAVFGFIDKEQLDKYV</u>

<u>ANGGKRSDWTVKFAENRSQDGTLLGYSLLQESVDQASYMYSDNHYLAEMATILGKPEEAKRYRQLAQ</u>

<u>QLADYINTCMFDPTTQFYYDVRIEDKPLANGCAGKPIVERGKGPEGWSPLFNGAATQANADAVVKVML</u>

<u>DPKEFNTFVPLGTAALTNPAFGADIYWRGRVWDQFWFGLKGMERYGYRDDALKLADTFFRHAKGLT</u>

<u>ADGPIQENYNPLTGAQQGAPNFSWSAAHLYMLYNDFFRKQ</u>*asgggsgggsgggsg*<u>NADNYKNVINRTGA</u>

<u>PQYMKDYDYDDHQRFNPFFDLGAWHGHLLPDGPNTMGGFPGVALLTEEYINFMASNFDRLTVWQDG</u>

<u>KKVDFTLEAYSIPGALVQKLTAKDVQVEMTLRFATPRTSLLETKITSNKPLDLVWDGELLEKLEAKEGKPL</u>

<u>SDKTIAGEYPDYQRKISATRDGLKVTFGKVRATWDLLTSGESEYQVHKSLPVQTEINGNRFTSKAHINGS</u>

<u>TTLYTTYSHLLTAQEVSKEQMQIRDILARPAFYLTASQQRWEEYLKKGLTNPDATPEQTRVAVKAIETLN</u>

<u>GNWRSPGGAVKFNTVTPSVTGRWFSGNQTWPWDTWKQAFAMAHFNPDIAKENIRAVFSWQIQPGDS</u>

<u>VRPQDVGFVPDLIAWNLSPERGGDGGNWNERNTKPSLAAWSVMEVYNVTQDKTWVAEMYPKLVAYH</u>

<u>DWWLRNRDHNGNGVPEYGATRDKAHNTESGEMLFTVKK</u>*D*SLRLSCAASGRTFSTAAMGWFRQAPG

KERDFVAGIYWTVGSTYYADSAKGRFTISRDNAKNTVYLQMDSLKPEDTAVYYCAARRRGFTLAPTR

ANEYDYWGQGTQVTVSShhhhhhepea

>SEQ ID NO: 142-144: Mb<sub>Nb207</sub><sup>cYgiK</sup>A2, C4 and F5, resp.

>SEQ ID NO: 145: Mb<sub>Nb207</sub><sup>c7HopQ</sup> C<sub>14</sub>-C<sub>512</sub>
(<u>Nb<sub>GFP</sub>207 β-strand A</u>, <u>HopQ sequences underlined</u>, Nb<sub>GFP</sub>207 β-strands B to G in bold *Cysteines connecting Nanobody to scaffold in bold italics* ) 6xHis tag, EPEA tag)
<u>QVQLVESGGGLVC</u>KTTTSVIDTTNDAQNLLTQAQTIVNTLKDYCPILIAKSSSNGGTNNANTPSWQTA

GGGKNSCATFGAEFSAASDMINNAQKIVQETQQLSANQPKNITQPHNLNLNSPSSLTALAQKMLKNAQS

QAEILKLANQVSDFNKLSSGHLKDYIGKCCDASAISSANMTMQNQKNNWGNGCAGVEETQSLLKTSAA

DFNNQTPQINQAQNLANTLIQELGNNTYEQLSRLLTNDNGTNSKTSAQAINQAVNNLNERAKTLAGGTT

NSPAYQATLLALRSVLGLWNSMGYAVICGGYTKSPGENNQKDFHYTDENGNGTTINCGGSTNSNGTH

SYNGTNTLKADKNVSLSIEQYEKIHEAYQILSKALKQAGLAPLNSKGEKLEAHVTTSKYGSLRLSCAASG

RTFSTAAMGWFRQAPGKERDFVAGIYWTVGSTYYADSAKGRFTISRDNAKNTVYLQMDSLKPEDTAV

**YYCAARRRGFTLAPTRANEYDYWGQGTQVTV*C***hhhhhhepea

>SEQ ID NO: 146: Mb$_{Nb207}$$^{c7HopQ}$ C$_{402}$-C$_{474}$
(Nb$_{GFP}$207 β-strand A, HopQ sequences underlined, Nb$_{GFP}$207 β-strands B to G in bold *Cysteines connecting Nanobody to scaffold in bold italics* ), 6xHis tag, EPEA tag)
<u>QVQLVESGGGLVQTKTTTSVIDTTNDAQNLLTQAQTIVNTLKDYCPILIAKSSSNGGTNNANTPSWQTA</u>

<u>GGGKNSCATFGAEFSAASDMINNAQKIVQETQQLSANQPKNITQPHNLNLNSPSSLTALAQKMLKNAQS</u>

<u>QAEILKLANQVESDFNKLSSGHLKDYIGKCDASAISSANMTMQNQKNNWGNGCAGVEETQSLLKTSAA</u>

<u>DFNNQTPQINQAQNLANTLIQELGNNTYEQLSRLLTNDNGTNSKTSAQAINQAVNNLNERAKTLAGGTT</u>

<u>NSPAYQATLLALRSVLGLWNSMGYAVICGGYTKSPGENNQKDFHYTDENGNGTTINCGGSTNSNGTH</u>

<u>SYNGTNTLKADKNVSLSIEQYEKIHEAYQILSKALKQAGLAPLNSKGEKLEAHVTTSK</u>*C*GSLRLSCAASG

**RTFSTAAMGWFRQAPGKERDFVAGIYWTVGSTYYADSAKGRFTISRDNAKNTVYLQMDSL*C*PEDTAV**

YYCAARRRGFTLAPTRANEYDYWGQGTQVTVSShhhhhhepea

>SEQ ID NO: 147: Mb$_{Nb207}$$^{c7HopQ}$ C$_{316}$-C$_{472}$
(Nb$_{GFP}$207 β-strand A, HopQ sequences underlined, Nb$_{GFP}$207 β-strands B to G in bold *Cysteines connecting Nanobody to scaffold in bold italics* ) 6xHis tag, EPEA tag)
<u>QVQLVESGGGLVQTKTTTSVIDTTNDAQNLLTQAQTIVNTLKDYCPILIAKSSSNGGTNNANTPSWQTA</u>

<u>GGGKNSCATFGAEFSAASDMINNAQKIVQETQQLSANQPKNITQPHNLNLNSPSSLTALAQKMLKNAQS</u>

<u>QAEILKLANQVESDFNKLSSGHLKDYIGKCDASAISSANMTMQNQKNNWGNGCAGVEETQSLLKTSAA</u>

<u>DFNNQTPQINQAQNLANTLIQELGNNTYEQLSRLLTNDNGTNSKTSAQAINQAVNNLNERAKTLAGGTT</u>

<u>NSPAYQATLLALRSVLGLWNSMGYAVICGGYTKSPGENNCKDFHYTDENGNGTTINCGGSTNSNGTHS</u>

<u>YNGTNTLKADKNVSLSIEQYEKIHEAYQILSKALKQAGLAPLNSKGEKLEAHVTTSKY</u>GSLRLSCAASGR

TFSTAAMGWFRQAPGKERDFVAGIYWTVGSTYYADSAKGRFTISRDNAKNTVYLQMDCLKPEDTAVY

YCAARRRGFTLAPTRANEYDYWGQGTQVTVSShhhhhhepea

>SEQ ID NO: 148: Mb$_{Nb207}$$^{c7HopQ}$ C$_{314}$-C$_{472}$
(Nb$_{GFP}$207 β-strand A, HopQ sequences underlined, Nb$_{GFP}$207 β-strands B to G in bold *Cysteines connecting Nanobody to scaffold in bold italics* ) 6xHis tag, EPEA tag)
<u>QVQLVESGGGLVQTKTTTSVIDTTNDAQNLLTQAQTIVNTLKDYCPILIAKSSSNGGTNNANTPSWQTA</u>

<u>GGGKNSCATFGAEFSAASDMINNAQKIVQETQQLSANQPKNITQPHNLNLNSPSSLTALAQKMLKNAQS</u>

<u>QAEILKLANQVESDFNKLSSGHLKDYIGKCDASAISSANMTMQNQKNNWGNGCAGVEETQSLLKTSAA</u>

<u>DFNNQTPQINQAQNLANTLIQELGNNTYEQLSRLLTNDNGTNSKTSAQAINQAVNNLNERAKTLAGGTT</u>

<u>NSPAYQATLLALRSVLGLWNSMGYAVICGGYTKSPGECNQKDFHYTDENGNGTTINCGGSTNSNGTH</u>

<u>SYNGTNTLKADKNVSLSIEQYEKIHEAYQILSKALKQAGLAPLNSKGEKLEAHVTTSKY</u>GSLRLSCAASG

**RTFSTAAMGWFRQAPGKERDFVAGIYWTVGSTYYADSAKGRFTISRDNAKNTVYLQM*C*SLKPEDTAV**

YYCAARRRGFTLAPTRANEYDYWGQGTQVTVSShhhhhhepea

>SEQ ID NO: 149: Mb$_{Nb207}$$^{c7HopQ}$ C$_{312}$-C$_{453}$
(Nb$_{GFP}$207 β-strand A, HopQ sequences underlined, Nb$_{GFP}$207 β-strands B to G in bold *Cysteines connecting Nanobody to scaffold in bold italics* ) 6xHis tag, EPEA tag)
<u>QVQLVESGGGLVQTKTTTSVIDTTNDAQNLLTQAQTIVNTLKDYCPILIAKSSSNGGTNNANTPSWQTA</u>

<u>GGGKNSCATFGAEFSAASDMINNAQKIVQETQQLSANQPKNITQPHNLNLNSPSSLTALAQKMLKNAQS</u>

<u>QAEILKLANQVESDFNKLSSGHLKDYIGKCDASAISSANMTMQNQKNNWGNGCAGVEETQSLLKTSAA</u>

<u>DFNNQTPQINQAQNLANTLIQELGNNTYEQLSRLLTNDNGTNSKTSAQAINQAVNNLNERAKTLAGGTT</u>

<u>NSPAYQATLLALRSVLGLWNSMGYAVICGGYTKSPCENNQKDFHYTDENGNGTTINCGGSTNSNGTHS</u>

<u>YNGTNTLKADKNVSLSIEQYEKIHEAYQILSKALKQAGLAPLNSKGEKLEAHVTTSKY</u>GSLRLSCAASGR

**TFSTAAMGWFRQAPGKERDFVAGIYWTVGSTYYADSAKC*RFTISRDNAKNTVYLQMDSLKPEDTAVY**

YCAARRRGFTLAPTRANEYDYWGQGTQVTVSShhhhhhepea

>SEQ ID NO: 150: Mb$_{Nb207}^{c7HopQ}$ C$_{349}$-C$_{452}$
(Nb$_{GFP}$207 β-strand A, HopQ sequences underlined, Nb$_{GFP}$207 β-strands B to G in bold *Cysteines connecting Nanobody to scaffold in bold italics* ) 6xHis tag, EPEA tag)
<u>QVQLVESGGGLVQTKTTTSVIDTTNDAQNLLTQAQTIVNTLKDYCPILIAKSSSNGGTNNANTPSWQTA</u>

<u>GGGKNSCATFGAEFSAASDMINNAQKIVQETQQLSANQPKNITQPHNLNLNSPSSLTALAQKMLKNAQS</u>

<u>QAEILKLANQVESDFNKLSSGHLKDYIGKCDASAISSANMTMQNQKNNWGNGCAGVEETQSLLKTSAA</u>

<u>DFNNQTPQINQAQNLNTLIQELGNNTYEQLSRLLTNDNGTNSKTSQAINQAVNNLNERKTLAGGTT</u>

<u>NSPAYQATLLALRSVLGLWNSMGYAVICGGYTKSPGENNQKDFHYTDENGNGTTINCGGSTNSNGTH</u>

<u>SYNGTC*</u>TLKADKNVSLSIEQYEKIHEAYQILSKALKQAGLAPLNSKGEKLEAHVTTSKYGSLRLSCAASG

RTFSTAAMGWFRQAPGKERDFVAGIYWTVGSTYYADSACGRFTISRDNAKNTVYLQMDSLKPEDTAV

YYCAARRRGFTLAPTRANEYDYWGQGTQVTVSShhhhhhepea

>SEQ ID NO: 151-158: Mb$_{Nb207}^{Azurin}$ A8, D9, D10, D11, G6, B8, B2, and C8, resp.

>SEQ ID NO: 159: Mb$_{Nb207}^{cPP7x2}$A3 (MP1403_A3)
(Nb$_{GFP}$207 sequences in bold, *linkers in italics*, PP7 sequences underlined, tags in small letters)
MQVQLVESGGGLVQ<u>ATRTLTEIQSTADRQIFEEKVGPLVGRLRLTASLRQNGAKTAYRVNLKLDQADVV</u>

<u>DCSTSVCGELPKVRYTQVWSHDVTIVANSTEASRKSLYDLTKSLVATSQVEDLVVNLVPLGR</u>*GLGS*<u>KTI</u>

<u>VLSVGEATRTLTEIQSTADRQIFEEKVGPLVGRLRLTASLRQNGAKTAYRVNLKLDQADVVDCSTSVCG</u>

<u>ELPKVRYTQVWSHDVTIVANSTEASRKSLYDLTKSLVATSQVEDLVVNLVPLGRRGSKTIVLS</u>GSLRLSC

AASGRTFSTAAMGWFRQAPGKERDFVAGIYWTVGSTYYADSAKGRFTISRDNAKNTVYLQMDSLKP

EDTAVYYCAARRRGFTLAPTRANEYDYWGQGTQVTVSShhhhhhepea

>SEQ ID NO: 160-165: Mb$_{Nb207}^{cPP7x2}$ D3, G5, E6, D7, A9, B9, resp. (MP1403)

>SEQ ID NO: 166: AP205 *Acinetobacter* phage coat protein NP_085472.1

>SEQ ID NO: 167: Mb$_{Nb207}^{AP205x2}$ XX
(Nb$_{GFP}$207 sequences in bold, *random linker in italics*, X is a short peptide linker (of 1 amino acid), AP205 sequences underlined, tags in small letters)
MQVQLVESGGGLX<u>KPMQPITSTANKIVWSDPTRLSTTFSASLLRQRVKVGIAELNNVSGQYVSVYKRPA</u>

<u>PKPEGCADACVIMPNENQSIRTVISGSAENLATLKAEWETHKRNVDTLFASGNAGLGFLDPTAAIVSSDK</u>

<u>PMQPITSTANKIVWSDPTRLSTTFSASLLRQRVKVGIAELNNVSGQYVSVYKRPAPKPEGCADACVIMP</u>

<u>NENQSIRTVISGSAENLATLKAEWETHKRNVDTLFASGNAGLGFLDPTAAIVS</u>XGSLRLSCAASGRTFST

AAMGWFRQAPGKERDFVAGIYWTVGSTYYADSAKGRFTISRDNAKNTVYLQMDSLKPEDTAVYYCA

ARRRGFTLAPTRANEYDYWGQGTQVTVSSHHHHHHEPEA

>SEQ ID NO: 168-172: Mb$_{Nb207}^{AP205x2}$C5, B7, B8, D3, A4, resp.

>SEQ ID NO: 173: Mb$_{Nb207}^{AP205}$ XX
(Nb$_{GFP}$207 sequences in bold, *random linker in italics*, X is a short peptide linker (of 1 amino acid), AP205 sequences underlined, tags in small letters)
MQVQLVESGGGLX<u>KPMQPITSTANKIVWSDPTRLSTTFSASLLRQRVKVGIAELNNVSGQYVSVYKRPA</u>

<u>PKPEGCADACVIMPNENQSIRTVISGSAENLATLKAEWETHKRNVDTLFASGNAGLGFLDPTAAIVS</u>XGS

LRLSCAASGRTFSTAAMGWFRQAPGKERDFVAGIYWTVGSTYYADSAKGRFTISRDNAKNTVYLQM

DSLKPEDTAVYYCAARRRGFTLAPTRANEYDYWGQGTQVTVSSHHHHHHEPEA

>SEQ ID NO: 174-183: Mb$_{Nb207}^{AP205}$C12, A4, E8, D10, A3, A10, D10, D2, C10, F1, resp.

>SEQ ID NO: 184: N2b$_{Nb207}^{NbFedF9}$E
(Nb$_{GFP}$207 β-strand A double underlined, Nb$_{GFP}$207 in bold, and Nb$_{FedF}$9 sequences are underlined), *linker sequences are in italic*
<u>QVQLVESGGGLVQ</u>*TENH*<u>QLQESGGGLVQAGG</u>SLRLSCAASGRTFSTAAMGWFRQAPGKERDFVAG

IYWTVGSTYYADSAKGRFTISRDNAKNTVYLQMDSLKPEDTAVYYCAARRRGFTLAPTRANEYDYWX

XXX<u>GSLRLSCAASGYTYSSNCMAWFRQVPGKEREGVASINTRGGITYYADSVKGRFTISRDNAKNTVS</u>

<u>LQMNSLKPEDTATYYCAAVREATYSDNRCSVRSYTYDWGQGTQVTVS</u>*GQE*GQGTQVTVSShhhhhhe pea -continued >SEQ ID NO: 185: N2b$_{Nb207}^{NbFedF9}$Q
(Nb$_{GFP}$207 β-strand A double underlined, Nb$_{GFP}$207 in bold, and Nb$_{FedF}$9 sequences are underlined), linker sequences are in italic
<u>QVQLVESGGGLVQ</u>*TENH*QLQESGGGLVQAGGSLRLSCAASGRTFSTAAMGWFRQAPGKERDFVAG

IYWTVGSTYYADSAKGRFTISRDNAKNTVYLQMDSLKPEDTAVYYCAARRRGFTLAPTRANEYDYWX

XXX<u>GSLRLSCAASGYTYSSNCMAWFRQVPGKEREGVASINTRGGITYYADSVKGRFTISRDNAKNTVS</u>

<u>LQMNSLKPEDTATYYCAAVREATYSDNRCSVRSYTYDYWGQGTQVTVS</u>*GQQ*GQGTQVTVSShhhhhh epea >SEQ ID NO: 186: N2b$_{Nb207}^{NbFedF9}$ CA14543 (MP1411_B3)

>SEQ ID NO: 187: N2b$_{Nb207}^{NbFedF9}$ CA14544 (MP1411_C6)

>SEQ ID NO: 188: N2b$_{Nb207}^{NbFedF9}$ CA14546 (MP1438_A5)

>SEQ ID NO: 189: N2b$_{Nb207}^{NbFedF9}$ CA14548 (MP1438_B11)

>SEQ ID NO: 190: N2b$_{Nb207}^{NbFedF9}$ CA14550 (MP1438_D2)

>SEQ ID NO: 191: N2b$_{Nb207}^{NbFedF9}$ CA14552 (MP1440_C5)

>SEQ ID NO: 192: *Mycobacterium tuberculosis* dodecin Rv1498A protein (GenBank Accession Number: 3205040)

>SEQ ID NO: 193: Mb$_{Nb207}^{Dodecin}$randomlinkers Megabody
(Nb$_{GFP}$207 sequences in bold, X is a short peptide linker (1 amino acids) of mixed composition, <u>dodecin Rv1498A protein sequences underlined</u>, 6xHis tag, EPEA tag)
QVQLVESGGGLX<u>TYRVIEIVGTSPDGVDAAIQGGLARAAQTMRALDWFEVQSIRGHLVDGAVAHFQVT</u>

<u>MKVGFRX</u>SLRLSCAASGRTFSTAAMGWFRQAPGKERDFVAGIYWTVGSTYYADSAKGRFTISRDNA

KNTVYLQMDSLKPEDTAVYYCAARRRGFTLAPTRANEYDYWGQGTQVTVSShhhhhepea

>SEQ ID NO: 194: Mb$_{Nb35}^{cYgjkE2}$

>SEQ ID NO: 195: Mb$_{Nb80}^{cYgjkE2}$

>SEQ ID NO: 196: Mb$_{Nb25}^{cYgjkE2}$

>SEQ ID NO: 197: Mb$_{Nb38}^{cYgjkE2}$

>SEQ ID NO: 198: Nb22 Tropomyosin-Related Kinase receptor B (TrkB)-specific Nanobody >SEQ ID NO: 199: Mb$_{Nb22}^{cYgjkE2}$ >SEQ ID NO: 200: *Burkholderia cenocepacia* 4QYB protein (PDB 4QYB)

>SEQ ID NO: 201-204: Mb$_{Nb207}^{4QYB}$randomlinkers
(Nb$_{GFP}$207 sequences in bold, (X)$_{1-2}$ is a short peptide linker (1 or 2 amino acids) of mixed composition, <u>4QYB protein sequences underlined</u>, 6xHis tag, EPEA tag)
QVQLVESGGGLV(X)$_{1-2}$<u>MQVQDLTGAALDYWATAEGHEVPRADASGCTSIREPGGVPTPFAPSSSW</u>

<u>ADGGPIVERLPFAGFERDGGRGAWRAVLHRAVPAAGERCTFNQSGPTLLIAAMRTLVASTFGDD</u>(X)$_{1-2}$

GSLRLSCAASGRTFSTAAMGWFRQAPGKERDFVAGIYWTVGSTYYADSAKGRFTISRDNAKNTVY

LQMDSLKPEDTAVYYCAARRRGFTLAPTRANEYDYWGQGTQVTVSShhhhhepea

>SEQ ID NO: 205-208: PelB_Mb$_{Nb207}^{4QYB}$randomlinkers
(<u>the PelB leader sequence double underlined</u>, Nb$_{GFP}$207 sequences in bold, (X)$_{1-2}$ is a short peptide linker (1 or 2 amino acids) of mixed composition, <u>4QYB protein sequences underlined</u>, 6xHis tag, EPEA tag)
<u>MKYLLPTAAAGLLLLAAQPAMA</u>QVQLVESGGGLV(X)$_{1-2}$<u>MQVQDLTGAALDYWATAEGHEVPRADASG</u>

<u>CTSIREPGGVPTPFAPSSSWADGGPIVERLPFAGFERDGGRGAWRAVLHRAVPAAGERCTFNQSGPT</u>

<u>LLIAAMRTLVASTFGDD</u>(X)$_{1-2}$GSLRLSCAASGRTFSTAAMGWFRQAPGKERDFVAGIYWTVGSTYYAD

SAKGRFTISRDNAKNTVYLQMDSLKPEDTAVYYCAARRRGFTLAPTRANEYDYWGQGTQVTVSShhh hhepea

>SEQ ID NO: 209: affinity tag (U.S. Pat. No. 9,518,084 B2)
EPEA

>SEQ ID NO: 210-213: sequences from FIG. 8C.

REFERENCES

Bliven, S., Prlic, A. (2012). Circular permutation in proteins. PLOS Comput. Biol. 8(3):e1002445.

Boder, E. T., and Wittrup, K. D. (1997). Yeast surface display for screening combinatorial polypeptide libraries. Nat Biotechnol 15, 553-557.

Chao, G., Lau, W. L., Hackel, B. J., Sazinsky, S. L., Lippow, S. M., and Wittrup, K. D. (2006). Isolating and engineering human antibodies using yeast surface display. Nat Protoc 1, 755-768.

Chothia, C., Lesk, A. M. (1987). Canonical structures for the hypervariable regions of immunoglobulins. Mol. Biol. 196(4):901-17.

Coscia, F., Estrozi, L. F., Hans, F., Malet, H., Noirclerc-Savoye, M., Schoehn, G., and Petosa, C. (2016). Fusion to a homo-oligomeric scaffold allows cryo-EM analysis of a small protein. Nature Scientific reports. 6:30909. doi: 10.1038/srep30909.

Desmyter A, Transue T. R., Ghahroudi M. A., Thi M. H., Poortmans F., Hamers R., Muyldermans S. and Wyns L. (1996). Crystal structure of a camel single-domain VH antibody fragment in complex with lysozyme. Nature Structural Biology 3, 803-811.

Ehrenmann, F., Kaas, Q., Lefranc, M-P. (2010). IMGT/3D structure-DB and IMGT/Domain Gap Align: a database and a tool for immunoglobulins or antibodies, T cell receptors, MHC, IgSF and MhcSF. Nucleic Acids Res, 38:D301-7.doi:10.1093/nar/gkp946.

Ehrenmann, F., Lefranc, M-P. (2011). IMGT/3D structure-DB: querying the IMGT database for 3D structures in immunology and immunoinformatics (IGorantibodies, TR, MH, RPI, andFPIA). ColdSpring Harb Protoc, 6:750-61. doi:1 0.1101/pdb.prot5637.

Harmsen, M. M., Ruuls, R. C., Nijman, I. J., Niewold, T. A., Frenken, L. G. J., and de Geus, B. (2000). Llama heavy-chain V regions consist of at least four distinct subfamilies revealing novel sequence features. Molecular immunology 37, 579-590.

Henderson, R. (1995). The potential and limitations of neutrons, electrons and X-rays for atomic resolution microscopy of unstained biological molecules. Quarterly reviews of biophysics. 28: 171-193.

Hunte, C., and Michel, H. (2002) Crystallisation of membrane proteins mediated by antibody fragments. Curr Opin Struct Biol 12, 503-508.

Hunynh K. et al, (2015) Analysis of protein stability and ligand interactions by thermal shift assay. Curr Protoc Protein Sci.; 79: 28.9.1-28.9.14.

Javaheri, A., Kruse, T., Moonens, K., Mejías-Luque, R., Debraekeleer, A., Asche, C. I., Tegtmeyer, N., Kalali, B., Bach, N. C., Sieber, S. A., Hill, D. J., Königer, V., Hauck, C. R., Moskalenko, R., Haas, R., Busch, D. H., Klaile, E., Slevogt, H., Schmidt, A., Backert, S., Remaut, H., Singer, B. B., and Gerhard, M. (2016). *Helicobacter pylori* adhesin HopQ engages in a virulence-enhancing interaction with human CEACAMs. Nature Microbiology 2, 16189.

Johnsson, N., George, N., and Johnsson, K. (2005). Protein chemistry on the surface of living cells. Chembiochem: a European journal of chemical biology 6, 47-52.

Kaas, Q., Ruiz, M., Lefranc, M-P. (2004). IMGT/3D structure-DB and IMGT/Structural Query, a database and a tool for immunoglobulin, T cell receptor and MHC structural data. Nucleic Acids Res 32: D208-10.doi:10.1093/nar/gkh042.

Kabat, E. A., Wu, T. T., Perry, H. M., Gottesman, K. S., Foeller, C. (1991). Sequences of Proteins of Immunological Interest. Washington, DC: U. S. Department of Health and Human Services (USDHHS), National Institute of Health NIH Publication. p. 91-3242.

King I. C., Gleixner, J., Doyle, L., Kuzin, A., Hunt, J. F., Xiao, R., Montelione, G. T., Stoddard, B. L., DiMaio, F., and Baker, D. (2015). Precise assembly of complex beta sheet topologies from de novo designed building blocks. eLife 4:el 1012. doi: 10.7554/eLife. 11012.

Koide, S. (2009). Engineering of recombinant crystallization chaperones. Curr Opin Struct Biol 19(4): 449-457.

Koide, S., Koide, A., and Lipovsek, D. (2012) Target-binding proteins based on the 10th human fibronectin type III domain ((1)(0)Fn3). Methods Enzymol 503, 135-156.

Lefranc, M-P., Pommié, C., Ruiz, M., Giudicelli, V., Foulquier, E., Truong, L., et al. (2003). IMGT unique numbering for immunoglobulin and Tcell receptor variable domains and Ig superfamily V-like domains. Dev Comp Immunol 27:55-77.doi:10.1016/S0145-305X(02)00039-3.

Lefranc, M-P. (2014). Immunoglobulin and T cell receptor genes: IMGT® and the birth of immunoinformatics. Frontiers in Immunology. 5 (22): 1-22.

Lin, J., Cheng, N., Hogle, J. M., Steven, A. C., and Belnap, D. M. (2013). Conformational Shift of a Major Poliovirus Antigen Confirmed by Immuno-Cryogenic Electron Microscopy. J Immunol. 191(2). doi:1 0.4049/jimmunol. 1202014.

Liu F. et al. (2011). Structural and biophysical characterization of *Mycobacterium tuberculosis* dodecin Rv1498A, Journal of Structural Biology; 175(1):31-8.

Manglik, A., Kobilka, B. K., and Steyaert, J. (2017). Nanobodies to Study G Protein-Coupled Receptor Structure and Function. Annu Rev Pharmacol Toxicol. 57: 19-37.

Miller, P. S., et al. (2017). Structural basis for $GABA_A$ receptor potentiation by neurosteroids. Nat Struct Mol Biol 24(11): 986-992.

Miller, P. et al. (2018). Heteromeric $GABA_A$ receptor structures in positively-modulated active states. bioRxiv, June 4; doi: http://dx.doi.org/10.1101/338343.

Moonens, K., De Kerpel, M., Coddens, A., Cox, E., Pardon, E., Remaut, H., and Degreeve, H. (2014). Nanobody Mediated Inhibition of Attachment of F18 Fimbriae Expressing *Escherichia coli*. PLoS ONE. 9(12): el 14691. doi:10.1371/journal.pone. 0114691.

Nogales, E. (2016). The development of cryo-EM into a mainstream structural biology technique. Nature Methods 13, 24-27.

O'Rourke, J. P., Peabody, D. S., and Chackerian, B. (2015). Affinity selection of epitope-based vaccines using a bacteriophage virus-like particle platform. Current opinion in virology 11, 76-82.

Pardon, E., Laeremans, T., Triest, S., Rasmussen, S. G., Wohlkonig, A., Ruf, A., Muyldermans, S., Hol, W. G., Kobilka, B. K., and Steyaert, J. (2014). A general protocol for the generation of Nanobodies for structural biology. Nature Protocols. 9: 674-693.

Rakestraw J, Sazinsky S, Piatesi A, Antipov E, Wittrup K. (2009). Directed evolution of a secretory leader for the improved expression of heterologous proteins and full-length antibodies in *Saccharomyces cerevisiae*. Biotechnol. Bioeng. 103, 1192-1201.

Rasmussen, S. G., DeVree, B. T., Zou, Y., Kruse, A. C., Chung, K. Y., Kobilka, T. S., Thian, F. S., Chae, P. S., Pardon, E., Calinski, D., Mathiesen, J. M., Shah, S. T., Lyons, J. A., Caffrey, M., Gellman, S. H., Steyaert, J., Skiniotis, G., Weis, W. I., Sunahara, R. K., and Kobilka, B. K. (2011a). Crystal structure of the b2 adrenergic receptor-Gs protein complex. Nature 477, 549-555.

Rasmussen, S. G., Choi, H. J., Fung, J. J., Pardon, E., Casarosa, P., Chae, P. S., Devree, B. T., Rosenbaum, D. M., Thian, F. S., Kobilka, T. S., Schnapp, A., Konetzki, I., Sunahara, R. K., Gellman, S. H., Pautsch, A., Steyaert, J., Weis, W. I., and Kobilka, B. K. (2011b). Structure of a Nanobody-stabilized active state of the b2 adrenoceptor. Nature 469, 175-180.

Rostislavleva, K., Soler, N., Ohashi, Y., Zhang, L., Pardon, E., Burke, J. E., Masson, G. R., Johnson, C., Steyaert, J., Ktistakis, N. T., and Williams, R. L. (2015). Structure and flexibility of the endosomal Vps34 complex reveals the basis of its function on membranes. Science. 350 (6257): aac7365.

Scholz, O., Thiel, A., Hillen, W., and Niederweis, M. (2000). Quantitative analysis of gene expression with an improved green fluorescent protein. European journal of biochemistry/FEBS 267, 1565-1570.

Sha, F., Salzman, G., Gupta, A., and Koide, S. (2017). Monobodies and other synthetic binding proteins for expanding protein science. Protein Science. 26:910-924.

Shishovs M, Rumnieks J, Diebolder C, Jaudzems K, Andreas LB, Stanek J, et al. (2016). Structure of AP205 Coat Protein Reveals Circular Permutation in ssRNA Bacteriophages. Journal of Molecular Biology. Academic Press; 428(21):4267-79.

Spencer-Smith, R., Koide, A., Zhou, Y., Eguchi, R. R., Sha, F., Gajwani, P., Santana, D., Gupta, A., Jacobs, M., Herrero-Garcia, E., Cobbert, J., Lavoie, H., Smith, M., Rajakulendran, T., Dowdell, E., Okur, M. N., Dementieva, I., Sicheri, F., Therrien, M., Hancock, J. F., Ikura, M., Koide, S., and O'Bryan, J. P. (2017). Inhibition of RAS function through targeting an allosteric regulatory site. Nat Chem Biol 13, 62-68.

Staus, D. P., Strachan, R. T., Manglik, A., Pani, B., Kahsai, A. W., Kim, T. H., Wingler, L. M., Ahn, S., Chatterjee, A., Masoudi, A., Kruse, A. C., Pardon, E., Steyaert, J., Weis, W. I., Prosser, R. S., Kobilka, B. K., Costa, T., and Lefkowitz, R. J. (2016). Allosteric Nanobodies reveal the dynamic range and diverse mechanisms of G-protein-coupled receptor activation. Nature 535, 448-452.

Wu et al. (2012). Fabs Enable Single Particle cryoEM Studies of Small Proteins. Structure. 20: 582-592.

Yin, J., Lin, A. J., Golan, D. E., and Walsh, C. T. (2006) Site-specific protein labeling by Sfp phosphopantetheinyl transferase. Nat Protoc 1, 280-285.

Yoshii, A. and M. Constantine-Paton (2010). "Postsynaptic BDNF-TrkB signaling in synapse maturation, plasticity, and disease." Dev Neurobiol 70(5): 304-322.

Zhang, Y., Liu, Y., Schultz, P. G., Wang, F. (2015). Rational design of humanized dual-agonist antibodies. J. Am. Chem. Soc. 137:38-41.

SEQUENCE LISTING (220 sequences)

SEQ ID NO: 1 - protein, 126 aa, Artificial Sequence
  NbGFP207 GFP-specific Nanobody
QVQLVESGGGLVQAGGSLRLSCAASGRTFSTAAMGWFRQAPGKERDFVAGIYWTVGSTYYADSAKGRFTISRDNAKNTVYLQMDSLKPEDTAVYYCAARRRGFTLAPTRANEYDYWGQGTQVTVSS

SEQ ID NO: 2 - protein, 128 aa, Artificial Sequence
  bacteriophage of P. Aeruginosa PP7 coat protein monomer
MSKTIVLSVGEATRTLTEIQSTADRQIFEEKVGPLVGRLRLTASLRQNGAKTAYRVNLKLDQADVVDCSTSVCGELPKVRYTQVWSHDVTIVANSTEASRKSLYDLTKSLVATSQVEDLVVNLVPLGR

SEQ ID NO: 3 - protein, 390 aa, Artificial Sequence
  MbNb207cPP7x2L dimer
  misc_feature (132)..(132): Xaa can be any naturally occurring amino acid
  misc_feature (261)..(261): Xaa can be any naturally occurring amino acid
MQVQLVESGGGLVQATRTLTEIQSTADRQIFEEKVGPLVGRLRLTASLRQNGAKTAYRVNLKLDQADVVDCSTSVCGELPKVRYTQVWSHDVTIVANSTEASRKSLYDLTKSLVATSQVEDLVVNLVPLGRXGSKTIVLSVGEATRTLTEIQSTADRQIFEEKVGPLVGRLRLTASLRQNGAKTAYRVNLKLDQADVVDCSTSVCGELPKVRYTQVWSHDVTIVANSTEASRKSLYDLTKSLVATSQVEDLVVNLVPLGRXGSKTIVLSGSLRLSCAASGRTFSTAAMGWFRQAPGKERDFVAGIYWTVGSTYYADSAKGRFTISRDNAKNTVYLQMDSLKPEDTAVYYCAARRRGFTLAPTRANEYDYWGQGTQVTVSSHHHHHHEPEA

SEQ ID NO: 4 - protein, 391 aa, Artificial Sequence
  MbNb207cPP7x2L dimer
  misc_feature (132)..(133): Xaa can be any naturally occurring amino acid
  misc_feature (262)..(262): Xaa can be any naturally occurring amino acid
MQVQLVESGGGLVQATRTLTEIQSTADRQIFEEKVGPLVGRLRLTASLRQNGAKTAYRVNLKLDQADVVDCSTSVCGELPKVRYTQVWSHDVTIVANSTEASRKSLYDLTKSLVATSQVEDLVVNLVPLGRXXGSKTIVLSVGEATRTLTEIQSTADRQIFEEKVGPLVGRLRLTASLRQNGAKTAYRVNLKLDQADVVDCSTSVCGELPKVRYTQVWSHDVTIVANSTEASRKSLYDLTKSLVATSQVEDLVVNLVPLGRXGSKTIVLSGSLRLSCAASGRTFSTAAMGWFRQAPGKERDFVAGIYWTVGSTYYADSAKGRFTISRDNAKNTVYLQMDSLKPEDTAVYYCAARRRGFTLAPTRANEYDYWGQGTQVTVSSHHHHHHEPEA

SEQ ID NO: 5 - protein, 391 aa, Artificial Sequence
  MbNb207cPP7x2L dimer
  misc_feature (132)..(132): Xaa can be any naturally occurring amino acid
  misc_feature (261)..(262): Xaa can be any naturally occurring amino acid
MQVQLVESGGGLVQATRTLTEIQSTADRQIFEEKVGPLVGRLRLTASLRQNGAKTAYRVNLKLDQADVVDCSTSVCGELPKVRYTQVWSHDVTIVANSTEASRKSLYDLTKSLVATSQVEDLVVNLVPLGRXGSKTIVLSVGEATRTLTEIQSTADRQIFEEKVGPLVGRLRLTASLRQNGAKTAYRVNLKLDQADVVDCSTSVCGELPKVRYTQVWSHDVTIVANSTEASRKSLYDLTKSLVATSQVEDLVVNLVPLGRXXGSKTIVLSGSLRLSCAASGRTFSTAAMGWFRQAPGKERDFVAGIYWTVGSTYYADSAKGRFTISRDNAKNTVYLQMDSLKPEDTAVYYCAARRRGFTLAPTRANEYDYWGQGTQVTVSSHHHHHHEPEA

SEQ ID NO: 6 - protein, 392 aa, Artificial Sequence
  MbNb207cPP7x2L dimer
  misc_feature (132)..(133): Xaa can be any naturally occurring amino acid
  misc_feature (262)..(263): Xaa can be any naturally occurring amino acid
MQVQLVESGGGLVQATRTLTEIQSTADRQIFEEKVGPLVGRLRLTASLRQNGAKTAYRVNLKLDQADVVDCSTSVCGELPKVRYTQVWSHDVTIVANSTEASRKSLYDLTKSLVATSQVEDLVVNLVPLGRXXGSKTIVLSVGEATRTLTEIQSTADRQIFEEKVGPLVGRLRLTASLRQNGAKTAYRVNLKLDQADVVDCSTSVCGELPKVRYTQVWSHDVTIVANSTEASRKSLYDLTKSLVATSQVEDLVVNLVPLGRXXGSKTIVLSGSLRLSCAASGRTFSTAAMGWFRQAPGKERDFVAGIYWTVGSTYYADSAKGRFTISRDNAKNTVYLQMDSLKPEDTAVYYCAARRRGFTLAPTRANEYDYWGQGTQVTVSSHHHHHHEPEA

SEQ ID NO: 7 - protein, 133 aa, Artificial Sequence
  cAbLys3 hen egg-white lysozyme specific Nanobody (PDB 1MEL)
DVQLQASGGGSVQAGGSLRLSCAASGYTIGPYCMGWFRQAPGKEREGVAAINMGGGITYYADSVKGRFTISQDNAKNTVYLLMNSLEPEDTAIYYCAADSTIYASYYECGHGLSTGGYGYDSWGQGTQVTVSS

SEQ ID NO: 8 - protein, 130 aa, Artificial Sequence
  bacteriophage of Escherichia coli coat protein monomer (PDB 2MS2)
MASNFTQFVLVDNGGTGDVTVAPSNFANGVAEWISSNSRSQAYKVTCSVRQSSAQNRKYTIKVEVPKVATQTVGGVELPVAAWRSYLNMELTIPIFATNSDCELIVKAMQGLLKDGNPIPSAIAANSGIY

SEQ ID NO: 9 - protein, 400 aa, Artificial Sequence
  MbcAbLys3cMS2x2 L dimer
  misc_feature (14)..(15): Xaa can be any naturally occurring amino acid
  misc_feature (272)..(273): Xaa can be any naturally occurring amino acid
MQVQLQESGGGLVXXGDVTVAPSNFANGVAEWISSNSRSQAYKVTCSVRQSSAQNRKYTIKVEVPKVATQTVGGVELPVAAWRSYLNMELTIPIFATNSDCELIVKAMQGLLKDGNPIPSAIAANSGIYASNFTQFVLVDNGGTGDVTVAPSNFANGVAEWISSNSRSQAYKVTCSVRQSSAQNRKYTIKVEVPKVATQTVGGVELPVAAWRSYLNMELTIPIFATNSDCELIVKAMQGLLKDGNPIPSAIAANSGIYASNFTQFVLVDNGXXSLRLSCAASGYTIGPYCMGWFRQAPGKEREGVAAINMGGGITYYADSVKGRFTISQDNAKNTVYLLMNSLEPEDTAIYYCAADSTIYASYYECGHGLSTGGYGYDSWGQGTQVTVSSHHHHHHEPEA

SEQ ID NO: 10 - protein, 398 aa, Artificial Sequence
  MbcAbLys3cMS2x2 L dimer
  misc_feature (14)..(14): Xaa can be any naturally occurring amino acid
  misc_feature (271)..(271): Xaa can be any naturally occurring amino acid
MQVQLQESGGGLVXGDVTVAPSNFANGVAEWISSNSRSQAYKVTCSVRQSSAQNRKYTIKVEVPKVATQTVGGVELPVAAWRSYLNMELTIPIFATNSDCELIVKAMQGLLKDGNPIPSAIAANSGIYASNFTQFVLVDNGGTGDVTVAPSNFANGVAEWISSNSRSQAYKVTCSVRQSSAQNRKYTIKVEVPKVATQTVGGVELPVAAWRSYLNMELTIPIFATNSDCELIVKAMQGLLKDGNPIPSAIAANSGIYASNFTQFVLVDNGXSLRLSCAASGYTIGPYCMGWFRQAPGKEREGVAAINMGGGITYYADSVKGRFTISQDNAKNTVYLLMNSLEPEDTAIYYCAADSTIYASYYECGHGLSTGGYGYDSWGQGTQVTVSSHHHHHHEPEA

SEQ ID NO: 11 - protein, 399 aa, Artificial Sequence
  MbcAbLys3cMS2x2 L dimer
  misc_feature (14)..(15): Xaa can be any naturally occurring amino acid
  misc_feature (272)..(272): Xaa can be any naturally occurring amino acid
MQVQLQESGGGLVXXGDVTVAPSNFANGVAEWISSNSRSQAYKVTCSVRQSSAQNRKYTIKVEVPKVATQTVGGVELPVAAWRSYLNMELTIPIFATNSDCELIVKAMQGLLKDGNPIPSAIAANSGIYASNFTQFVLVDNGGTGDVTVAPSNFANGVAEWISSNSRSQAYKVTCSVRQSSAQNRKYTIKVEVPKVATQTVGGVELPVAAWRSYLNMELTIPIFATNSDCELIVKAMQGLLKDGNPIPSAIAANSGIYASNFTQFVLVDNGXSLRLSCAASGYTIGPYCMGWFRQAPGKEREGVAAINMGGGITYYADSVKGRFTISQDNAKNTVYLLMNSLEPEDTAIYYCAADSTIYASYYECGHGLSTGGYGYDSWGQGTQVTVSSHHHHHHEPEA

SEQ ID NO: 12 - protein, 399 aa, Artificial Sequence
  MbcAbLys3cMS2x2 L dimer
  misc_feature (14)..(14): Xaa can be any naturally occurring amino acid
  misc_feature (271)..(272): Xaa can be any naturally occurring amino acid
MQVQLQESGGGLVXGDVTVAPSNFANGVAEWISSNSRSQAYKVTCSVRQSSAQNRKYTIKVEVPKVATQTVGGVELPVAAWRSYLNMELTIPIFATNSDCELIVKAMQGLLKDGNPIPSAIAANSGIYASNFTQFVLVDNGGTGDVTVAPSNFANGVAEWISSNSRSQAYKVTCSVRQSSAQNRKYTIKVEVPKVATQTVGGVELPVAAWRSYLNMELTIPIFATNSDCELIVKAMQGLLKDGNPIPSAIAANSGIYASNFTQFVLVDNGXXSLRLSCAASGYTIGPYCMGWFRQAPGKEREGVAAINMGGGITYYADSVKGRFTISQDNAKNTVYLLMNSLEPEDTAIYYCAADSTIYASYYECGHGLSTGGYGYDSWGQGTQVTVSSHHHHHHEPEA

SEQ ID NO: 13 - protein, 400 aa, Artificial Sequence; identical to SEQ ID NO: 9
  MbcAbLys3cMS2x2 L dimer
  misc_feature (14)..(15): Xaa can be any naturally occurring amino acid
  misc_feature (272)..(273): Xaa can be any naturally occurring amino acid

SEQ ID NO: 14 - protein, 279 aa, Artificial Sequence
  N2bNb207cAbLys3 Nano2body
  misc_feature (16)..(18): Xaa can be any naturally occurring amino acid
  misc_feature (137)..(138): Xaa can be any naturally occurring amino acid
  misc_feature (257)..(259): Xaa can be any naturally occurring amino acid
QVQLVESGGGLVQAGXXXGVQLVESGGGLVQAGGSLRLSCAASGRTFSTAAMGWFRQAPGKERDFVAGIYWTVGSTYYADSAKGRFTISRDNAKNTVYLQMDSLKPEDTAVYYCAARRRGFTLAPTRANEYDYWGQXXGSLRLSCAASGYTIGPYCMGWFRQAPGKEREGVAAINMGGGITYYADSVKGRFTISQDNAKNTVYLLMNSLEPEDTAIYYCAADSTIYASYYECGHGLSTGGYGYDSWGQGTQVTVSSXXXGQGTQVTVSSHHHHHHEPEA

SEQ ID NO: 15 - protein, 720 aa, Artificial Sequence
  PelB__N2bNb207cAbLys3L_tags, amberstopcodon(*)_protein3 Nano2body
  misc_feature (38)..(40): Xaa can be any naturally occurring amino acid
  misc_feature (159)..(160): Xaa can be any naturally occurring amino acid
  misc_feature (279)..(281): Xaa can be any naturally occurring amino acid
MKYLLPTAAAGLLLLAAQPAMAQVQLVESGGGLVQAGXXXGVQLVESGGGLVQAGGSLRLSCAASGRTFSTAAMGWFRQAPGKERDFVAGIYWTVGSTYYADSAKGRFTISRDNAKNTVYLQMDSLKPEDTAVYYCAARRRGFTLAPTRANEYDYWGQXXGSLRLSCAASGYTIGPYCMGWFRQAPGKEREGVAAINMGGGITYYADSVKGRFTISQDNAKNTVYLLMNSLEPEDTAIYYCAADSTIYASYYECGHGLSTGGYGYDSWGQGTQVTVSSXXXGQGTQVTVSSHHHHHHEPEAYPYDVPDYGSTVESCLAKPHTENSFTNVWKDDKTLDRYANYEGCLWNATGVVVCTGDETQCYGTWVPIGLAIPENEGGGSEGGGSEGGGSEGGGTKPPEYGDTPIPGYTYINPLDGTYPPGTEQNPANPNPSLEESQPLNTFMFQNNRFRNRQGALTVYTGTVTQGTDPVKTYYQYTPVSSKAMYDAYWNGKFRDCAFHSGFNEDPFVCEYQGQSSDLPQPPVNAGGGSGGGSGGGSEGGGSEGGGSEGGGSEGGGSEGGGSGGGSGSGDFDYEKMANANKGAMTENADENALQSDAKGKLDSVATDYGAAIDGFIGDVSGLANGNGATGDFAGSNSQMAQVGDGDNSPLMNNFRQYLPSLPQSVECRPYVFGAGKPYEFSIDCDKINLFRGVFAFLLYVATFMYVFSTFANILRNKES

SEQ ID NO: 16 - protein, 717 aa, Artificial Sequence
  DsbA_N2bNb207cAbLys3L_tags, amberstopcodon(*)_protein3 Nano2body
  misc_feature (35)..(37): Xaa can be any naturally occurring amino acid
  misc_feature (156)..(157): Xaa can be any naturally occurring amino acid
  misc_feature (276)..(278): Xaa can be any naturally occurring amino acid
MKKIWLALAGLVLAFSASAQVQLVESGGGLVQAGXXXGVQLVESGGGLVQAGGSLRLSCAASGRTFSTAAMGWFRQAPGKERDFVAGIYWTVGSTYYADSAKGRFTISRDNAKNTVYLQMDSLKPEDTAVYYCAARRRGFTLAPTRANEYDYWGQXXGSLRLSCAASGYTIGPYCMGWFRQAPGKEREGVAAINMGGGITYYADSVKGRFTISQDNAKNTVYLLMNSLEPEDTAIYYCAADSTIYASYYECGHGLSTGGYGYDSWGQGTQVTVSSXXXGQGTQVTVSSHHHHHHEPEAYPYDVPDYGSTVESCLAKPHTENSFTNVWKDDKTLDRYANYEGCLWNATGVVVCTGDETQCYGTWVPIGLAIPENEGGGSEGGGSEGGGSEGGGTKPPEYGDTPIPGYTYINPLDGTYPPGTEQNPANPNPSLEESQPLNTFMFQNNRFRNRQGALTVYTGTVTQGTDPVKTYYQYTPVSSKAMYDAYWNGKFRDCAFHSGFNEDPFVCEYQGQSSDLPQPPVNAGGGSGGGSGGGSEGGGSEGGGSEGGGSEGGGSEGGGSGGGSGSGDFDYEKMANANKGAMTENADENALQSDAKGKLDSVATDYGAAIDGFIGDVSGLANGNGATGDFAGSNSQMAQVGDGDNSPLMNNFRQYLPSLPQSVECRPYVFGAGKPYEFSIDCDKINLFRGVFAFLLYVATFMYVFSTFANILRNKES

SEQ ID NO: 17 - protein, 129 aa, Artificial Sequence
  NbFEDF9 the lectin domain of the F18 fimbrial adhesin FedF specific Nanobody (PDB 4W6Y)
QVQLQESGGGSVQAGGSLRLSCAASGYTYSSNCMAWFRQVPGKEREGVASINTRGGITYYADSVKGRFTISRDNAKNTVSLQMNSLKPEDTATYYCAAVREATYSDNRCSVRSYTYDYWGQGTQVTVSS

SEQ ID NO: 18 - protein, 275 aa, Artificial Sequence
  N2bNb207NbFEDF9L Nano2body
  misc_feature (16)..(18): Xaa can be any naturally occurring amino acid
  misc_feature (137)..(138): Xaa can be any naturally occurring amino acid
  misc_feature (253)..(255): Xaa can be any naturally occurring amino acid
QVQLVESGGGLVQAGXXXGVQLVESGGGLVQAGGSLRLSCAASGRTFSTAAMGWFRQAPGKERDFVAGIYWTVGSTYYADSAKGRFTISRDNAKNTVYLQMDSLKPEDTAVYYCAARRRGFTLAPTRANEYDYWGQXXGSLRLSCAASGYTYSSNCMAWFRQVPGKEREGVASINTRGGITYYADSVKGRFTISRDNAKNTVSLQMNSLKPEDTATYYCAAVREATYSDNRCSVRSYTYDYWGQGTQVTVSSXXXGQGTQVTVSSHHHHHHEPEA

SEQ ID NO: 19 - protein, 434 aa, Artificial Sequence
  Helicobacter pylori strain G27 HopQ adhesin domain protein (PDB 5LP2)
MAVQKVKNADKVQKLSDTYEQLSRLLTNDNGTNSKTSAQAINQAVNNLNERAKTLAGGTTNSPAYQATLLALRSVLGLWNSMGYAVICGGYTKSPGENNQKDFHYTDENGNGTTINCGGSTNSNGTHSYNGTNTLKADKNVSLSIEQYEKIHEAYQILSKALKQAGLAPLNSKGEKLEAHVTTSKYQQDNQTKTTTSVIDTTNDAQNLLTQAQTIVNTLKDYCPILIAKSSSSNGGTNNANTPSWQTAGGGKNSCATFGAEFSAASDMINNAQKIVQETQQLSANQPKNITQPHNLNLNSPSSLTALAQKMLKNAQSQAEILKLANQVESDFNKLSSGHLKDYIGKCDASAISSANMTMQNQKNNWGNGCAGVEETQSLLKTSAADFNNQTPQINQAQNLANTLIQELGNNPFRNMGMIASSTTNNGAHHHHHH

SEQ ID NO: 20 - protein, 542 aa, Artificial Sequence
  Chimeric protein
QVQLVESGGGLVQTKTTTSVIDTTNDAQNLLTQAQTIVNTLKDYCPILIAKSSSSNGGTNNANTPSWQTAGGGKNSCATFGAEFSAASDMINNAQKIVQETQQLSANQPKNITQPHNLNLNSPSSLTALAQKMLKNAQSQAEILKLANQVESDFNKLSSGHLKDYIGKCDASAISSANMTMQNQKNNWGNGCAGVEETQSLLKTSAADFNNQTPQINQAQNLANTLIQELGNNPFRASGGGSGGGGSGKLSDTYEQLSRLLTNDNGTNSKTSAQAINQAVNNLNERAKTLAGGTTNSPAYQATLLALRSVLGLWNSMGYAVICGGYTKSPGENNQKDFHYTDENGNGTTINCGGSTNSNGTHSYNGTNTLKADKNVSLSIEQYEKIHEAYQILSKALKQAGLAPLNSKGEKLEAHVTTSKYGSLRLSCAASGRTFSTAAMGWFRQAPGKERDFVAGIYWTVGSTYYADSAKGRFTISRDNAKNTVYLQMDSLKPEDTAVYYCAARRRGFTLAPTRANEYDYWGQGTQVTVSSHHHHHHEPEA

SEQ ID NO: 21 - protein, 12 aa, Artificial Sequence
  cHopQ circular permutation linker peptide
ASGGGSGGGGSG

SEQ ID NO: 22 - protein, 821 aa, Artificial Sequence
  MbNb207cHopQ_Aga2p_ACP protein sequence
MRFPSIFTAVVFAASSALAAPANTTAEDETAQIPAEAVIGYLGLEGDSDVAALPLSDSTNNGSLSTNTTIASIAAKEEGVQLDKREAEAQVQLVESGGGLVQTKTTTSVIDTTNDAQNLLTQAQTIVNTLKDYCPILIAKSSSSNGGTNNANTPSWQTAGGGKNSCATFGAEFSAASDMINNAQKIVQETQQLSANQPKNITQPHNLNLNSPSSLTALAQKMLKNAQSQAEILKLANQVESDFNKLSSGHLKDYIGKCDASAISSANMTMQNQKNNWGNGCAGVEETQSLLKTSAADFNNQTPQINQAQNLANTLIQELGNNPFRASGGGSGGGGSGKLSDTYEQLSRLLTNDNGTNSKTSAQAINQAVNNLNERAKTLAGGTTNSPAYQATLLALRSVLGLWNSMGYAVICGGYTKSPGENNQKDFHYTDENGNGTTINCGGSTNSNGTHSYNGTNTLKADKNVSLSIEQYEKIHEAYQILSKALKQAGLAPLNSKGEKLEAHVTTSKYGSLRLSCAASGRTFSTAAMGWFRQAPGKERDFVAGIYWTVGSTYYADSAKGRFTISRDNAKNTVYLQMDSLKPEDTAVYYCAARRRGFTLAPTRANEYDYWGQGTQVTVSSLGGGSGGGGSGGGGSGGGGSGGGGSGGGGSGGGGSQELTTICEQIPSPTLESTPYSLSTTTILANGKAMQGVFEYYKSVTFVSNCGSHPSTTSKGSPINTQYVFKDNSSTSMSTIEERVKKIIGEQLGVKQEEVTNNASFVEDLGADSLDTVELVMALEEEFDTEIPDEEAEKITTVQAAIDYINGHQASEQKLISEEDL

SEQ ID NO: 23 - protein, 561 aa, Artificial Sequence
  Chimeric protein
MKKIWLALAGLVLAFSASAQVQLVESGGGLVQTKTTTSVIDTTNDAQNLLTQAQTIVNTLKDYCPILIAKSSSSNGGTNNANTPSWQTAGGGKNSCATFGAEFSAASDMINNAQKIVQETQQLSANQPKNITQPHNLNLNSPSSLTALAQKMLKNAQSQAEILKLANQVESDFNKLSSGHLKDYIGKCDASAISSANMTMQNQKNNWGNGCAGVEETQSLLKTSAADFNNQTPQINQAQNLANTLIQELGNNPFRASGGGSGGGGSGKLSDTYEQLSRLLTNDNGTNSKTSAQAINQAVNNLNERAKTLAGGTTNSPAYQATLLALRSVLGLWNSMGYAVICGGYTKSPGENNQKDFHYTDENGNGTTINCGGSTNSNGTHSYNGTNTLKADKNVSLSIEQYEKIHEAYQILSKALKQAGLAPLNSKGEKLEAHVTTSKYGSLRLSCAASGRTFSTAAMGWFRQAPGKERDFVAGIYWTVGSTYYADSAKGRFTISRDNAKNTVYLQMDSLKPEDTAVYYCAARRRGFTLAPTRANEYDYWGQGTQVTVSSHHHHHHEPEA

SEQ ID NO: 24 - protein, 128 aa, Artificial Sequence
  Nb35 Gbeta/Galpha subunit of the beta2 adrenergic receptor-Gs protein complex-specific Nanobody
QVQLQESGGGLVQPGGSLRLSCAASGFTFSNYKMNWVRQAPGKGLEWVSDISQSGASISYTGSVKGRFTISRDNAKNTLYLQMNSLKPEDTAVYYCARCPAPFTRDCFDVTSTTYAYRGQGTQVTVSS

SEQ ID NO: 25 - protein, 544 aa, Artificial Sequence
  Chimeric protein
QVQLVESGGGLVQTKTTTSVIDTTNDAQNLLTQAQTIVNTLKDYCPILIAKSSSSNGGTNNANTPSWQTAGGGKNSCATFGAEFSAASDMINNAQKIVQETQQLSANQPKNITQPHNLNLNSPSSLTALAQKMLKNAQSQAEILKLANQVESDFNKLSSGHLKDYIGKCDASAISSANMTMQNQKNNWGNGCAGVEETQSLLKTSAADFNNQTPQINQAQNLANTLIQELGNNPFRASGGGSGGGGSGKLSDTYEQLSRLLTNDNGTNSKTSAQAINQAVNNLNERAKTLAGGTTNSPAYQATLLALRSVLGLWNSMGYAVICGGYTKSPGENNQKDFHYTDENGNGTTINCGGSTNSNGTHSYNGTNTLKADKNVSLSIEQYEKIHEAYQILSKALKQAGLAPLNSKGEKLEAHVTTSKYGSLRLSCAASGFTFSNYKMNWVRQAPGKGLEWVSDISQSGASISYTGSVKGRFTISRDNAKNTLYLQMNSLKPEDTAVYYCARCPAPFTRDCFDVTSTTYAYRGQGTQVTVSSHHHHHHEPEA

SEQ ID NO: 26 - protein, 120 aa, Artificial Sequence
  Nb80 beta2 adrenergic receptor-specific Nanobody
QVQLQESGGGLVQAGGSLRLSCAASGSIFSINTMGWYRQAPGKQRELVAAIHSGGSTNYANSVKGRFTISRDNAANTVYLQMNSLKPEDTAVYYCNVKDYGAVLYEYDYWGQGTQVTVSS

SEQ ID NO: 27 - protein, 536 aa, Artificial Sequence
  Chimeric protein
QVQLVESGGGLVQTKTTTSVIDTTNDAQNLLTQAQTIVNTLKDYCPILIAKSSSSNGGTNNANTPSWQTAGGGKNSCATFGAEFSAASDMINNAQKIVQETQQLSANQPKNITQPHNLNLNSPSSLTALAQKMLKNAQSQAEILKLANQVESDFNKLSSGHLKDYIGKCDASAISSANMTMQNQKNNWGNGCAGVEETQSLLKTSAADFNNQTPQINQAQNLANTLIQELGNNPFRASGGGSGGGGSGKLSDTYEQLSRLLTNDNGTNSKTSAQAINQAVNNLNERAKTLAGGTTNSPAYQATLLALRSVLGLWNSMGYAVICGGYTKSPGENNQKDFHYTDENGNGTTINCGGSTNSNGTHSYNGTNTLKADKNVSLSIEQYEKIHEAYQILSKALKQAGLAPLNSKGEKLEAHVTTSKYGSLRLSCAASGSIFSINTMGWYRQAPGKQRELVAAIHSGGSTNYANSVKGRFTISRDNAANTVYLQMNSLKPEDTAVYYCNVKDYGAVLYEYDYWGQGTQVTVSSHHHHHHEPEA

SEQ ID NO: 28 - protein, 125 aa, Artificial Sequence
  Nb25 GABAA-specific Nanobody
QVQLQESGGGLVQAGGSLRLSCAASGHTFNYPIMGWFRQAPGKEREFVGAISWSGGSTSYADSVKDRFTISRDNAKNTVYLEMNNLKPEDTAVYYCAAKGRYSGGLYYPTNYDYWGQGTQVTVSS

SEQ ID NO: 29 - protein, 541 aa, Artificial Sequence
  Chimeric protein
QVQLVESGGGLVQTKTTTSVIDTTNDAQNLLTQAQTIVNTLKDYCPILIAKSSSSNGGTNNANTPSWQTAGGGKNSCATFGAEFSAASDMINNAQKIVQETQQLSANQPKNITQPHNLNLNSPSSLTALAQKMLKNAQSQAEILKLANQVESDFNKLSSGHLKDYIGKCDASAISSANMTMQNQKNNWGNGCAGVEETQSLLKTSAADFNNQTPQINQAQNLANTLIQELGNNPFRASGGGSGGGGSGKLSDTYEQLSRLLTNDNGTNSKTSAQAINQAVNNLNERAKTLAGGTTNSPAYQATLLALRSVLGLWNSMGYAVICGGYTKSPGENNQKDFHYTDENGNGTTINCGGSTNSNGTHSYNGTNTLKADKNVSLSIEQYEKIHEAYQILSKALKQAGLAPLNSKGEKLEAHVTTSKYGSLRLSCAASGHTFNYPIMGWFRQAPGKEREFVGAISWSGGSTSYADSVKDRFTISRDNAKNTVYLEMNNLKPEDTAVYYCAAKGRYSGGLYYPTNYDYWGQGTQVTVSSHHHHHHEPEA

SEQ ID NO: 30 - protein, 540 aa, Artificial Sequence
  MbNb207cHopQrandomlinkers
  misc_feature (13)..(13): Xaa can be any naturally occurring amino acid
  misc_feature (420)..(420): Xaa can be any naturally occurring amino acid
QVQLVESGGGLVXKTTTSVIDTTNDAQNLLTQAQTIVNTLKDYCPILIAKSSSSNGGTNNANTPSWQTAGGGKNSCATFGAEFSAASDMINNAQKIVQETQQLSANQPKNITQPHNLNLNSPSSLTALAQKMLKNAQSQAEILKLANQVESDFNKLSSGHLKDYIGKCDASAISSANMTMQNQKNNWGNGCAGVEETQSLLKTSAADFNNQTPQINQAQNLANTLIQELGNNPFRASGGGSGGGGSGKLSDTYEQLSRLLTNDNGTNSKTSAQAINQAVNNLNERAKTLAGGTTNSPAYQATLLALRSVLGLWNSMGYAVICGGYTKSPGENNQKDFHYTDENGNGTTINCGGSTNSNGTHSYNGTNTLKADKNVSLSIEQYEKIHEAYQILSKALKQAGLAPLNSKGEKLEAHVTTSKXSLRLSCAASGRTFSTAAMGWFRQAPGKERDFVAGIYWTVGSTYYADSAKGRFTISRDNAKNTVYLQMDSLKPEDTAVYYCAARRRGFTLAPTRANEYDYWGQGTQVTVSSHHHHHHEPEA

SEQ ID NO: 31 - protein, 541 aa, Artificial Sequence
  MbNb207cHopQrandomlinkers
  misc_feature (13)..(14): Xaa can be any naturally occurring amino acid
  misc_feature (421)..(421): Xaa can be any naturally occurring amino acid
QVQLVESGGGLVXXKTTTSVIDTTNDAQNLLTQAQTIVNTLKDYCPILIAKSSSSNGGTNNANTPSWQTAGGGKNSCATFGAEFSAASDMINNAQKIVQETQQLSANQPKNITQPHNLNLNSPSSLTALAQKMLKNAQSQAEILKLANQVESDFNKLSSGHLKDYIGKCDASAISSANMTMQNQKNNWGNGCAGVEETQSLLKTSAADFNNQTPQINQAQNLANTLIQELGNNPFRASGGGSGGGGSGKLSDTYEQLSRLLTNDNGTNSKTSAQAINQAVNNLNERAKTLAGGTTNSPAYQATLLALRSVLGLWNSMGYAVICGGYTKSPGENNQKDFHYTDENGNGTTINCGGSTNSNGTHSYNGTNTLKADKNVSLSIEQYEKIHEAYQILSKALKQAGLAPLNSKGEKLEAHVTTSKXSLRLSCAASGRTFSTAAMGWFRQAPGKERDFVAGIYWTVGSTYYADSAKGRFTISRDNAKNTVYLQMDSLKPEDTAVYYCAARRRGFTLAPTRANEYDYWGQGTQVTVSSHHHHHHEPEA

SEQ ID NO: 32 - protein, 541 aa, Artificial Sequence
  MbNb207cHopQrandomlinkers
  misc_feature (13)..(13): Xaa can be any naturally occurring amino acid
  misc_feature (420)..(421): Xaa can be any naturally occurring amino acid
QVQLVESGGGLVXKTTTSVIDTTNDAQNLLTQAQTIVNTLKDYCPILIAKSSSSNGGTNNANTPSWQTAGGGKNSCATFGAEFSAASDMINNAQKIVQETQQLSANQPKNITQPHNLNLNSPSSLTALAQKMLKNAQSQAEILKLANQVESDFNKLSSGHLKDYIGKCDASAISSANMTMQNQKNNWGNGCAGVEETQSLLKTSAADFNNQTPQINQAQNLANTLIQELGNNPFRASGGGSGGGGSGKLSDTYEQLSRLLTNDNGTNSKTSAQAINQAVNNLNERAKTLAGGTTNSPAYQATLLALRSVLGLWNSMGYAVICGGYTKSPGENNQKDFHYTDENGNGTTINCGGSTNSNGTHSYNGTNTLKADKNVSLSIEQYEKIHEAYQILSKALKQAGLAPLNSKGEKLEAHVTTSKXXSLRLSCAASGRTFSTAAMGWFRQAPGKERDFVAGIYWTVGSTYYADSAKGRFTISRDNAKNTVYLQMDSLKPEDTAVYYCAARRRGFTLAPTRANEYDYWGQGTQVTVSSHHHHHHEPEA

SEQ ID NO: 33 - protein, 542 aa, Artificial Sequence
  MbNb207cHopQrandomlinkers
  misc_feature (13)..(14): Xaa can be any naturally occurring amino acid
  misc_feature (421)..(422): Xaa can be any naturally occurring amino acid
QVQLVESGGGLVXXKTTTSVIDTTNDAQNLLTQAQTIVNTLKDYCPILIAKSSSSNGGTNNANTPSWQTAGGGKNSCATFGAEFSAASDMINNAQKIVQETQQLSANQPKNITQPHNLNLNSPSSLTALAQKMLKNAQSQAEILKLANQVESDFNKLSSGHLKDYIGKCDASAISSANMTMQNQKNNWGNGCAGVEETQSLLKTSAADFNNQTPQINQAQNLANTLIQELGNNPFRASGGGSGGGGSGKLSDTYEQLSRLLTNDNGTNSKTSAQAINQAVNNLNERAKTLAGGTTNSPAYQATLLALRSVLGLWNSMGYAVICGGYTKSPGENNQKDFHYTDENGNGTTINCGGSTNSNGTHSYNGTNTLKADKNVSLSIEQYEKIHEAYQILSKALKQAGLAPLNSKGEKLEAHVTTSKXXSLRLSCAASGRTFSTAAMGWFRQAPGKERDFVAGIYWTVGSTYYADSAKGRFTISRDNAKNTVYLQMDSLKPEDTAVYYCAARRRGFTLAPTRANEYDYWGQGTQVTVSSHHHHHHEPEA

SEQ ID NO: 34 - protein, 819 aa, Artificial Sequence
  MbNb207cHopQrandomlinkers_Aga2p_ACP protein sequence
  misc_feature (102)..(102): Xaa can be any naturally occurring amino acid
  misc_feature (509)..(509): Xaa can be any naturally occurring amino acid
MRFPSIFTAVVFAASSALAAPANTTAEDETAQIPAEAVIGYLGLEGDSDVAALPLSDSTNNGSLSTNTTIASIAAKEEGVQLDKREAEAQVQLVESGGGLVXKTTTSVIDTTNDAQNLLTQAQTIVNTLKDYCPILIAKSSSSNGGTNNANTPSWQTAGGGKNSCATFGAEFSAASDMINNAQKIVQETQQLSANQPKNITQPHNLNLNSPSSLTALAQKMLKNAQSQAEILKLANQVESDFNKLSSGHLKDYIGKCDASAISSANMTMQNQKNNWGNGCAGVEETQSLLKTSAADFNNQTPQINQAQNLANTLIQELGNNPFRASGGGSGGGGSGKLSDTYEQLSRLLTNDNGTNSKTSAQAINQAVNNLNERAKTLAGGTTNSPAYQATLLALRSVLGLWNSMGYAVICGGYTKSPGENNQKDFHYTDENGNGTTINCGGSTNSNGTHSYNGTNTLKADKNVSLSIEQYEKIHEAYQILSKALKQAGLAPLNSKGEKLEAHVTTSKXSLRLSCAASGRTFSTAAMGWFRQAPGKERDFVAGIYWTVGSTYYADSAKGRFTISRDNAKNTVYLQMDSLKPEDTAVYYCAARRRGFTLAPTRANEYDYWGQGTQVTVSSLGGGSGGGGSGGGGSGGGGSGGGGSGGGGSGGGGSQELTTICEQIPSPTLESTPYSLSTTTILANGKAMQGVFEYYKSVTFVSNCGSHPSTTSKGSPINTQYVFKDNSSTSMSTIEERVKKIIGEQLGVKQEEVTNNASFVEDLGADSLDTVELVMALEEEFDTEIPDEEAEKITTVQAAIDYINGHQASEQKLISEEDL

SEQ ID NO: 35 - protein, 820 aa, Artificial Sequence
  MbNb207cHopQrandomlinkers_Aga2p_ACP protein sequence
  misc_feature (102)..(103): Xaa can be any naturally occurring amino acid
  misc_feature (510)..(510): Xaa can be any naturally occurring amino acid
MRFPSIFTAVVFAASSALAAPANTTAEDETAQIPAEAVIGYLGLEGDSDVAALPLSDSTNNGSLSTNTTIASIAAKEEGVQLDKREAEAQVQLVESGGGLVXXKTTTSVIDTTNDAQNLLTQAQTIVNTLKDYCPILIAKSSSSNGGTNNANTPSWQTAGGGKNSCATFGAEFSAASDMINNAQKIVQETQQLSANQPKNITQPHNLNLNSPSSLTALAQKMLKNAQSQAEILKLANQVESDFNKLSSGHLKDYIGKCDASAISSANMTMQNQKNNWGNGCAGVEETQSLLKTSAADFNNQTPQINQAQNLANTLIQELGNNPFRASGGGSGGGGSGKLSDTYEQLSRLLTNDNGTNSKTSAQAINQAVNNLNERAKTLAGGTTNSPAYQATLLALRSVLGLWNSMGYAVICGGYTKSPGENNQKDFHYTDENGNGTTINCGGSTNSNGTHSYNGTNTLKADKNVSLSIEQYEKIHEAYQILSKALKQAGLAPLNSKGEKLEAHVTTSKXSLRLSCAASGRTFSTAAMGWFRQAPGKERDFVAGIYWTVGSTYYADSAKGRFTISRDNAKNTVYLQMDSLKPEDTAVYYCAARRRGFTLAPTRANEYDYWGQGTQVTVSSLGGGSGGGGSGGGGSGGGGSGGGGSGGGGSGGGGSQELTTICEQIPSPTLESTPYSLSTTTILANGKAMQGVFEYYKSVTFVSNCGSHPSTTSKGSPINTQYVFKDNSSTSMSTIEERVKKIIGEQLGVKQEEVTNNASFVEDLGADSLDTVELVMALEEEFDTEIPDEEAEKITTVQAAIDYINGHQASEQKLISEEDL

SEQ ID NO: 36 - protein, 820 aa, Artificial Sequence
  MbNb207cHopQrandomlinkers_Aga2p_ACP protein sequence
  misc_feature (102)..(102): Xaa can be any naturally occurring amino acid
  misc_feature (509)..(510): Xaa can be any naturally occurring amino acid
MRFPSIFTAVVFAASSALAAPANTTAEDETAQIPAEAVIGYLGLEGDSDVAALPLSDSTNNGSLSTNTTIASIAAKEEGVQLDKREAEAQVQLVESGGGLVXKTTTSVIDTTNDAQNLLTQAQTIVNTLKDYCPILIAKSSSSNGGTNNANTPSWQTAGGGKNSCATFGAEFSAASDMINNAQKIVQETQQLSANQPKNITQPHNLNLNSPSSLTALAQKMLKNAQSQAEILKLANQVESDFNKLSSGHLKDYIGKCDASAISSANMTMQNQKNNWGNGCAGVEETQSLLKTSAADFNNQTPQINQAQNLANTLIQELGNNPFRASGGGSGGGGSGKLSDTYEQLSRLLTNDNGTNSKTSAQAINQAVNNLNERAKTLAGGTTNSPAYQATLLALRSVLGLWNSMGYAVICGGYTKSPGENNQKDFHYTDENGNGTTINCGGSTNSNGTHSYNGTNTLKADKNVSLSIEQYEKIHEAYQILSKALKQAGLAPLNSKGEKLEAHVTTSKXXSLRLSCAASGRTFSTAAMGWFRQAPGKERDFVAGIYWTVGSTYYADSAKGRFTISRDNAKNTVYLQMDSLKPEDTAVYYCAARRRGFTLAPTRANEYDYWGQGTQVTVSSLGGGSGGGGSGGGGSGGGGSGGGGSGGGGSGGGGSQELTTICEQIPSPTLESTPYSLSTTTILANGKAMQGVFEYYKSVTFVSNCGSHPSTTSKGSPINTQYVFKDNSSTSMSTIEERVKKIIGEQLGVKQEEVTNNASFVEDLGADSLDTVELVMALEEEFDTEIPDEEAEKITTVQAAIDYINGHQASEQKLISEEDL

SEQ ID NO: 37 - protein, 821 aa, Artificial Sequence
  MbNb207cHopQrandomlinkers_Aga2p_ACP protein sequence
  misc_feature (102)..(103): Xaa can be any naturally occurring amino acid
  misc_feature (510)..(511): Xaa can be any naturally occurring amino acid
MRFPSIFTAVVFAASSALAAPANTTAEDETAQIPAEAVIGYLGLEGDSDVAALPLSDSTNNGSLSTNTTIASIAAKEEGVQLDKREAEAQVQLVESGGGLVXXKTTTSVIDTTNDAQNLLTQAQTIVNTLKDYCPILIAKSSSSNGGTNNANTPSWQTAGGGKNSCATFGAEFSAASDMINNAQKIVQETQQLSANQPKNITQPHNLNLNSPSSLTALAQKMLKNAQSQAEILKLANQVESDFNKLSSGHLKDYIGKCDASAISSANMTMQNQKNNWGNGCAGVEETQSLLKTSAADFNNQTPQINQAQNLANTLIQELGNNPFRASGGGSGGGGSGKLSDTYEQLSRLLTNDNGTNSKTSAQAINQAVNNLNERAKTLAGGTTNSPAYQATLLALRSVLGLWNSMGYAVICGGYTKSPGENNQKDFHYTDENGNGTTINCGGSTNSNGTHSYNGTNTLKADKNVSLSIEQYEKIHEAYQILSKALKQAGLAPLNSKGEKLEAHVTTSKXXSLRLSCAASGRTFSTAAMGWFRQAPGKERDFVAGIYWTVGSTYYADSAKGRFTISRDNAKNTVYLQMDSLKPEDTAVYYCAARRRGFTLAPTRANEYDYWGQGTQVTVSSLGGGSGGGGSGGGGSGGGGSGGGGSGGGGSGGGGSQELTTICEQIPSPTLESTPYSLSTTTILANGKAMQGVFEYYKSVTFVSNCGSHPSTTSKGSPINTQYVFKDNSSTSMSTIEERVKKIIGEQLGVKQEEVTNNASFVEDLGADSLDTVELVMALEEEFDTEIPDEEAEKITTVQAAIDYINGHQASEQKLISEEDL

SEQ ID NO: 38 - protein, 760 aa, Escherichia coli
NADNYKNVINRTGAPQYMKDYDYDDHQRFNPFFDLGAWHGHLLPDGPNTMGGFPGVALLTEEYINFMASNFDRLTVWQDGKKVDFTLEAYSIPGALVQKLTAKDVQVEMTLRFATPRTSLLETKITSNKPLDLVWDGELLEKLEAKEGKPLSDKTIAGEYPDYQRKISATRDGLKVTFGKVRATWDLLTSGESEYQVHKSLPVQTEINGNRFTSKAHINGSTTLYTTYSHLLTAQEVSKEQMQIRDILARPAFYLTASQQRWEEYLKKGLTNPDATPEQTRVAVKAIETLNGNWRSPGGAVKFNTVTPSVTGRWFSGNQTWPWDTWKQAFAMAHFNPDIAKENIRAVFSWQIQPGDSVRPQDVGFVPDLIAWNLSPERGGDGGNWNERNTKPSLAAWSVMEVYNVTQDKTWVAEMYPKLVAYHDWWLRNRDHNGNGVPEYGATRDKAHNTESGEMLFTVKKGDKEETQSGLNNYARVVEKGQYDSLEIPAQVAASWESGRDDAAVFGFIDKEQLDKYVANGGKRSDWTVKFAENRSQDGTLLGYSLLQESVDQASYMYSDNHYLAEMATILGKPEEAKRYRQLAQQLADYINTCMFDPTTQFYYDVRIEDKPLANGCAGKPIVERGKGPEGWSPLFNGAATQANADAVVKVMLDPKEFNTFVPLGTAALTNPAFGADIYWRGRVWVDQFWFGLKGMERYGYRDDALKLADTFFRHAKGLTADGPIQENYNPLTGAQQGAPNFSWSAAHLYMLYNDFFRKQ

SEQ ID NO: 39 - protein, 909 aa, Artificial Sequence
  MbNb207cYgjkQrandomlinkers
  misc_feature (13)..(13): Xaa can be any naturally occurring amino acid
  misc_feature (789)..(789): Xaa can be any naturally occurring amino acid
QVQLVESGGGLVXKEETQSGLNNYARVVEKGQYDSLEIPAQVAASWESGRDDAAVFGFIDKEQLDKYVANGGKRSDWTVKFAENRSQDGTLLGYSLLQESVDQASYMYSDNHYLAEMATILGKPEEAKRYRQLAQQLADYINTCMFDPTTQFYYDVRIEDKPLANGCAGKPIVERGKGPEGWSPLFNGAATQANADAVVKVMLDPKEFNTFVPLGTAALTNPAFGADIYWRGRVWVDQFWFGLKGMERYGYRDDALKLADTFFRHAKGLTADGPIQENYNPLTGAQQGAPNFSWSAAHLYMLYNDFFRKQASGGGSGGGGSGGGGSGNADNYKNVINRTGAPQYMKDYDYDDHQRFNPFFDLGAWHGHLLPDGPNTMGGFPGVALLTEEYINFMASNFDRLTVWQDGKKVDFTLEAYSIPGALVQKLTAKDVQVEMTLRFATPRTSLLETKITSNKPLDLVWDGELLEKLEAKEGKPLSDKTIAGEYPDYQRKISATRDGLKVTFGKVRATWDLLTSGESEYQVHKSLPVQTEINGNRFTSKAHINGSTTLYTTYSHLLTAQEVSKEQMQIRDILARPAFYLTASQQRWEEYLKKGLTNPDATPEQTRVAVKAIETLNGNWRSPGGAVKFNTVTPSVTGRWFSGNQTWPWDTWKQAFAMAHFNPDIAKENIRAVFSWQIQPGDSVRPQDVGFVPDLIAWNLSPERGGDGGNWNERNTKPSLAAWSVMEVYNVTQDKTWVAEMYPKLVAYHDWWLRNRDHNGNGVPEYGATRDKAHNTESGEMLFTVKKXSLRLSCAASGRTFSTAAMGWFRQAPGKERDFVAGIYWTVGSTYYADSAKGRFTISRDNAKNTVYLQMDSLKPEDTAVYYCAARRRGFTLAPTRANEYDYWGQGTQVTVSSHHHHHHEPEA

SEQ ID NO: 40 - protein, 910 aa, Artificial Sequence
  MbNb207cYgjkQrandomlinkers
  misc_feature (13)..(14): Xaa can be any naturally occurring amino acid
  misc_feature (790)..(790): Xaa can be any naturally occurring amino acid
QVQLVESGGGLVXXKEETQSGLNNYARVVEKGQYDSLEIPAQVAASWESGRDDAAVFGFIDKEQLDKYVANGGKRSDWTVKFAENRSQDGTLLGYSLLQESVDQASYMYSDNHYLAEMATILGKPEEAKRYRQLAQQLADYINTCMFDPTTQFYYDVRIEDKPLANGCAGKPIVERGKGPEGWSPLFNGAATQANADAVVKVMLDPKEFNTFVPLGTAALTNPAFGADIYWRGRVWVDQFWFGLKGMERYGYRDDALKLADTFFRHAKGLTADGPIQENYNPLTGAQQGAPNFSWSAAHLYMLYNDFFRKQASGGGSGGGGSGGGGSGNADNYKNVINRTGAPQYMKDYDYDDHQRFNPFFDLGAWHGHLLPDGPNTMGGFPGVALLTEEYINFMASNFDRLTVWQDGKKVDFTLEAYSIPGALVQKLTAKDVQVEMTLRFATPRTSLLETKITSNKPLDLVWDGELLEKLEAKEGKPLSDKTIAGEYPDYQRKISATRDGLKVTFGKVRATWDLLTSGESEYQVHKSLPVQTEINGNRFTSKAHINGSTTLYTTYSHLLTAQEVSKEQMQIRDILARPAFYLTASQQRWEEYLKKGLTNPDATPEQTRVAVKAIETLNGNWRSPGGAVKFNTVTPSVTGRWFSGNQTWPWDTWKQAFAMAHFNPDIAKENIRAVFSWQIQPGDSVRPQDVGFVPDLIAWNLSPERGGDGGNWNERNTKPSLAAWSVMEVYNVTQDKTWVAEMYPKLVAYHDWWLRNRDHNGNGVPEYGATRDKAHNTESGEMLFTVKKXSLRLSCAASGRTFSTAAMGWFRQAPGKERDFVAGIYWTVGSTYYADSAKGRFTISRDNAKNTVYLQMDSLKPEDTAVYYCAARRRGFTLAPTRANEYDYWGQGTQVTVSSHHHHHHEPEA

SEQ ID NO: 41 - protein, 910 aa, Artificial Sequence
  MbNb207cYgjkQrandomlinkers
  misc_feature (13)..(13): Xaa can be any naturally occurring amino acid
  misc_feature (789)..(790): Xaa can be any naturally occurring amino acid
QVQLVESGGGLVXKEETQSGLNNYARVVEKGQYDSLEIPAQVAASWESGRDDAAVFGFIDKEQLDKYVANGGKRSDWTVKFAENRSQDGTLLGYSLLQESVDQASYMYSDNHYLAEMATILGKPEEAKRYRQLAQQLADYINTCMFDPTTQFYYDVRIEDKPLANGCAGKPIVERGKGPEGWSPLFNGAATQANADAVVKVMLDPKEFNTFVPLGTAALTNPAFGADIYWRGRVWVDQFWFGLKGMERYGYRDDALKLADTFFRHAKGLTADGPIQENYNPLTGAQQGAPNFSWSAAHLYMLYNDFFRKQASGGGSGGGGSGGGGSGNADNYKNVINRTGAPQYMKDYDYDDHQRFNPFFDLGAWHGHLLPDGPNTMGGFPGVALLTEEYINFMASNFDRLTVWQDGKKVDFTLEAYSIPGALVQKLTAKDVQVEMTLRFATPRTSLLETKITSNKPLDLVWDGELLEKLEAKEGKPLSDKTIAGEYPDYQRKISATRDGLKVTFGKVRATWDLLTSGESEYQVHKSLPVQTEINGNRFTSKAHINGSTTLYTTYSHLLTAQEVSKEQMQIRDILARPAFYLTASQQRWEEYLKKGLTNPDATPEQTRVAVKAIETLNGNWRSPGGAVKFNTVTPSVTGRWFSGNQTWPWDTWKQAFAMAHFNPDIAKENIRAVFSWQIQPGDSVRPQDVGFVPDLIAWNLSPERGGDGGNWNERNTKPSLAAWSVMEVYNVTQDKTWVAEMYPKLVAYHDWWLRNRDHNGNGVPEYGATRDKAHNTESGEMLFTVKKXXSLRLSCAASGRTFSTAAMGWFRQAPGKERDFVAGIYWTVGSTYYADSAKGRFTISRDNAKNTVYLQMDSLKPEDTAVYYCAARRRGFTLAPTRANEYDYWGQGTQVTVSSHHHHHHEPEA

SEQ ID NO: 42 - protein, 911 aa, Artificial Sequence
  MbNb207cYgjkQrandomlinkers
  misc_feature (13)..(14): Xaa can be any naturally occurring amino acid
  misc_feature (790)..(791): Xaa can be any naturally occurring amino acid
QVQLVESGGGLVXXKEETQSGLNNYARVVEKGQYDSLEIPAQVAASWESGRDDAAVFGFIDKEQLDKYVANGGKRSDWTVKFAENRSQDGTLLGYSLLQESVDQASYMYSDNHYLAEMATILGKPEEAKRYRQLAQQLADYINTCMFDPTTQFYYDVRIEDKPLANGCAGKPIVERGKGPEGWSPLFNGAATQANADAVVKVMLDPKEFNTFVPLGTAALTNPAFGADIYWRGRVWVDQFWFGLKGMERYGYRDDALKLADTFFRHAKGLTADGPIQENYNPLTGAQQGAPNFSWSAAHLYMLYNDFFRKQASGGGSGGGGSGGGGSGNADNYKNVINRTGAPQYMKDYDYDDHQRFNPFFDLGAWHGHLLPDGPNTMGGFPGVALLTEEYINFMASNFDRLTVWQDGKKVDFTLEAYSIPGALVQKLTAKDVQVEMTLRFATPRTSLLETKITSNKPLDLVWDGELLEKLEAKEGKPLSDKTIAGEYPDYQRKISATRDGLKVTFGKVRATWDLLTSGESEYQVHKSLPVQTEINGNRFTSKAHINGSTTLYTTYSHLLTAQEVSKEQMQIRDILARPAFYLTASQQRWEEYLKKGLTNPDATPEQTRVAVKAIETLNGNWRSPGGAVKFNTVTPSVTGRWFSGNQTWPWDTWKQAFAMAHFNPDIAKENIRAVFSWQIQPGDSVRPQDVGFVPDLIAWNLSPERGGDGGNWNERNTKPSLAAWSVMEVYNVTQDKTWVAEMYPKLVAYHDWWLRNRDHNGNGVPEYGATRDKAHNTESGEMLFTVKKXXSLRLSCAASGRTFSTAAMGWFRQAPGKERDFVAGIYWTVGSTYYADSAKGRFTISRDNAKNTVYLQMDSLKPEDTAVYYCAARRRGFTLAPTRANEYDYWGQGTQVTVSSHHHHHHEPEA

SEQ ID NO: 43 - protein, 17 aa, Artificial Sequence
  cYgjk circular permutation linker peptide
ASGGGSGGGGSGGGGSG

SEQ ID NO: 44 - protein, 1188 aa, Artificial Sequence
  MbNb207cYgjkrandomlinkers_Aga2p_ACP protein sequence
  misc_feature (102)..(102): Xaa can be any naturally occurring amino acid
  misc_feature (878)..(878): Xaa can be any naturally occurring amino acid
MRFPSIFTAVVFAASSALAAPANTTAEDETAQIPAEAVIGYLGLEGDSDVAALPLSDSTNNGSLSTNTTIASIAAKEEGVQLDKREAEAQVQLVESGGGLVXKEETQSGLNNYARVVEKGQYDSLEIPAQVAASWESGRDDAAVFGFIDKEQLDKYVANGGKRSDWTVKFAENRSQDGTLLGYSLLQESVDQASYMYSDNHYLAEMATILGKPEEAKRYRQLAQQLADYINTCMFDPTTQFYYDVRIEDKPLANGCAGKPIVERGKGPEGWSPLFNGAATQANADAVVKVMLDPKEFNTFVPLGTAALTNPAFGADIYWRGRVWVDQFWFGLKGMERYGYRDDALKLADTFFRHAKGLTADGPIQENYNPLTGAQQGAPNFSWSAAHLYMLYNDFFRKQASGGGSGGGGSGGGGSGNADNYKNVINRTGAPQYMKDYDYDDHQRFNPFFDLGAWHGHLLPDGPNTMGGFPGVALLTEEYINFMASNFDRLTVWQDGKKVDFTLEAYSIPGALVQKLTAKDVQVEMTLRFATPRTSLLETKITSNKPLDLVWDGELLEKLEAKEGKPLSDKTIAGEYPDYQRKISATRDGLKVTFGKVRATWDLLTSGESEYQVHKSLPVQTEINGNRFTSKAHINGSTTLYTTYSHLLTAQEVSKEQMQIRDILARPAFYLTASQQRWEEYLKKGLTNPDATPEQTRVAVKAIETLNGNWRSPGGAVKFNTVTPSVTGRWFSGNQTWPWDTWKQAFAMAHFNPDIAKENIRAVFSWQIQPGDSVRPQDVGFVPDLIAWNLSPERGGDGGNWNERNTKPSLAAWSVMEVYNVTQDKTWVAEMYPKLVAYHDWWLRNRDHNGNGVPEYGATRDKAHNTESGEMLFTVKKXSLRLSCAASGRTFSTAAMGWFRQAPGKERDFVAGIYWTVGSTYYADSAKGRFTISRDNAKNTVYLQMDSLKPEDTAVYYCAARRRGFTLAPTRANEYDYWGQGTQVTVSSLGGGSGGGGSGGGGSGGGGSGGGGSGGGGSGGGGSQELTTICEQIPSPTLESTPYSLSTTTILANGKAMQGVFEYYKSVTFVSNCGSHPSTTSKGSPINTQYVFKDNSSTSMSTIEERVKKIIGEQLGVKQEEVTNNASFVEDLGADSLDTVELVMALEEEFDTEIPDEEAEKITTVQAAIDYINGHQASEQKLISEEDL

SEQ ID NO: 45 - protein, 1189 aa, Artificial Sequence
  MbNb207cYgjkrandomlinkers_Aga2p_ACP protein sequence
  misc_feature (102)..(103): Xaa can be any naturally occurring amino acid
  misc_feature (879)..(879): Xaa can be any naturally occurring amino acid
MRFPSIFTAVVFAASSALAAPANTTAEDETAQIPAEAVIGYLGLEGDSDVAALPLSDSTNNGSLSTNTTIASIAAKEEGVQLDKREAEAQVQLVESGGGLVXXKEETQSGLNNYARVVEKGQYDSLEIPAQVAASWESGRDDAAVFGFIDKEQLDKYVANGGKRSDWTVKFAENRSQDGTLLGYSLLQESVDQASYMYSDNHYLAEMATILGKPEEAKRYRQLAQQLADYINTCMFDPTTQFYYDVRIEDKPLANGCAGKPIVERGKGPEGWSPLFNGAATQANADAVVKVMLDPKEFNTFVPLGTAALTNPAFGADIYWRGRVWVDQFWFGLKGMERYGYRDDALKLADTFFRHAKGLTADGPIQENYNPLTGAQQGAPNFSWSAAHLYMLYNDFFRKQASGGGSGGGGSGGGGSGNADNYKNVINRTGAPQYMKDYDYDDHQRFNPFFDLGAWHGHLLPDGPNTMGGFPGVALLTEEYINFMASNFDRLTVWQDGKKVDFTLEAYSIPGALVQKLTAKDVQVEMTLRFATPRTSLLETKITSNKPLDLVWDGELLEKLEAKEGKPLSDKTIAGEYPDYQRKISATRDGLKVTFGKVRATWDLLTSGESEYQVHKSLPVQTEINGNRFTSKAHINGSTTLYTTYSHLLTAQEVSKEQMQIRDILARPAFYLTASQQRWEEYLKKGLTNPDATPEQTRVAVKAIETLNGNWRSPGGAVKFNTVTPSVTGRWFSGNQTWPWDTWKQAFAMAHFNPDIAKENIRAVFSWQIQPGDSVRPQDVGFVPDLIAWNLSPERGGDGGNWNERNTKPSLAAWSVMEVYNVTQDKTWVAEMYPKLVAYHDWWLRNRDHNGNGVPEYGATRDKAHNTESGEMLFTVKKXSLRLSCAASGRTFSTAAMGWFRQAPGKERDFVAGIYWTVGSTYYADSAKGRFTISRDNAKNTVYLQMDSLKPEDTAVYYCAARRRGFTLAPTRANEYDYWGQGTQVTVSSLGGGSGGGGSGGGGSGGGGSGGGGSGGGGSGGGGSQELTTICEQIPSPTLESTPYSLSTTTILANGKAMQGVFEYYKSVTFVSNCGSHPSTTSKGSPINTQYVFKDNSSTSMSTIEERVKKIIGEQLGVKQEEVTNNASFVEDLGADSLDTVELVMALEEEFDTEIPDEEAEKITTVQAAIDYINGHQASEQKLISEEDL

SEQ ID NO: 46 - protein, 1189 aa, Artificial Sequence
  MbNb207cYgjkrandomlinkers_Aga2p_ACP protein sequence
  misc_feature (102)..(102): Xaa can be any naturally occurring amino acid
  misc_feature (878)..(879): Xaa can be any naturally occurring amino acid
MRFPSIFTAVVFAASSALAAPANTTAEDETAQIPAEAVIGYLGLEGDSDVAALPLSDSTNNGSLSTNTTIASIAAKEEGVQLDKREAEAQVQLVESGGGLVXKEETQSGLNNYARVVEKGQYDSLEIPAQVAASWESGRDDAAVFGFIDKEQLDKYVANGGKRSDWTVKFAENRSQDGTLLGYSLLQESVDQASYMYSDNHYLAEMATILGKPEEAKRYRQLAQQLADYINTCMFDPTTQFYYDVRIEDKPLANGCAGKPIVERGKGPEGWSPLFNGAATQANADAVVKVMLDPKEFNTFVPLGTAALTNPAFGADIYWRGRVWVDQFWFGLKGMERYGYRDDALKLADTFFRHAKGLTADGPIQENYNPLTGAQQGAPNFSWSAAHLYMLYNDFFRKQASGGGSGGGGSGGGGSGNADNYKNVINRTGAPQYMKDYDYDDHQRFNPFFDLGAWHGHLLPDGPNTMGGFPGVALLTEEYINFMASNFDRLTVWQDGKKVDFTLEAYSIPGALVQKLTAKDVQVEMTLRFATPRTSLLETKITSNKPLDLVWDGELLEKLEAKEGKPLSDKTIAGEYPDYQRKISATRDGLKVTFGKVRATWDLLTSGESEYQVHKSLPVQTEINGNRFTSKAHINGSTTLYTTYSHLLTAQEVSKEQMQIRDILARPAFYLTASQQRWEEYLKKGLTNPDATPEQTRVAVKAIETLNGNWRSPGGAVKFNTVTPSVTGRWFSGNQTWPWDTWKQAFAMAHFNPDIAKENIRAVFSWQIQPGDSVRPQDVGFVPDLIAWNLSPERGGDGGNWNERNTKPSLAAWSVMEVYNVTQDKTWVAEMYPKLVAYHDWWLRNRDHNGNGVPEYGATRDKAHNTESGEMLFTVKKXXSLRLSCAASGRTFSTAAMGWFRQAPGKERDFVAGIYWTVGSTYYADSAKGRFTISRDNAKNTVYLQMDSLKPEDTAVYYCAARRRGFTLAPTRANEYDYWGQGTQVTVSSLGGGSGGGGSGGGGSGGGGSGGGGSGGGGSGGGGSQELTTICEQIPSPTLESTPYSLSTTTILANGKAMQGVFEYYKSVTFVSNCGSHPSTTSKGSPINTQYVFKDNSSTSMSTIEERVKKIIGEQLGVKQEEVTNNASFVEDLGADSLDTVELVMALEEEFDTEIPDEEAEKITTVQAAIDYINGHQASEQKLISEEDL

SEQ ID NO: 47 - protein, 1190 aa, Artificial Sequence
  MbNb207cYgjkrandomlinkers_Aga2p_ACP protein sequence
  misc_feature (102)..(103): Xaa can be any naturally occurring amino acid
  misc_feature (879)..(880): Xaa can be any naturally occurring amino acid
MRFPSIFTAVVFAASSALAAPANTTAEDETAQIPAEAVIGYLGLEGDSDVAALPLSDSTNNGSLSTNTTIASIAAKEEGVQLDKREAEAQVQLVESGGGLVXXKEETQSGLNNYARVVEKGQYDSLEIPAQVAASWESGRDDAAVFGFIDKEQLDKYVANGGKRSDWTVKFAENRSQDGTLLGYSLLQESVDQASYMYSDNHYLAEMATILGKPEEAKRYRQLAQQLADYINTCMFDPTTQFYYDVRIEDKPLANGCAGKPIVERGKGPEGWSPLFNGAATQANADAVVKVMLDPKEFNTFVPLGTAALTNPAFGADIYWRGRVWVDQFWFGLKGMERYGYRDDALKLADTFFRHAKGLTADGPIQENYNPLTGAQQGAPNFSWSAAHLYMLYNDFFRKQASGGGSGGGGSGGGGSGNADNYKNVINRTGAPQYMKDYDYDDHQRFNPFFDLGAWHGHLLPDGPNTMGGFPGVALLTEEYINFMASNFDRLTVWQDGKKVDFTLEAYSIPGALVQKLTAKDVQVEMTLRFATPRTSLLETKITSNKPLDLVWDGELLEKLEAKEGKPLSDKTIAGEYPDYQRKISATRDGLKVTFGKVRATWDLLTSGESEYQVHKSLPVQTEINGNRFTSKAHINGSTTLYTTYSHLLTAQEVSKEQMQIRDILARPAFYLTASQQRWEEYLKKGLTNPDATPEQTRVAVKAIETLNGNWRSPGGAVKFNTVTPSVTGRWFSGNQTWPWDTWKQAFAMAHFNPDIAKENIRAVFSWQIQPGDSVRPQDVGFVPDLIAWNLSPERGGDGGNWNERNTKPSLAAWSVMEVYNVTQDKTWVAEMYPKLVAYHDWWLRNRDHNGNGVPEYGATRDKAHNTESGEMLFTVKKXXSLRLSCAASGRTFSTAAMGWFRQAPGKERDFVAGIYWTVGSTYYADSAKGRFTISRDNAKNTVYLQMDSLKPEDTAVYYCAARRRGFTLAPTRANEYDYWGQGTQVTVSSLGGGSGGGGSGGGGSGGGGSGGGGSGGGGSGGGGSQELTTICEQIPSPTLESTPYSLSTTTILANGKAMQGVFEYYKSVTFVSNCGSHPSTTSKGSPINTQYVFKDNSSTSMSTIEERVKKIIGEQLGVKQEEVTNNASFVEDLGADSLDTVELVMALEEEFDTEIPDEEAEKITTVQAAIDYINGHQASEQKLISEEDL

SEQ ID NO: 48 - protein, 542 aa, Artificial Sequence
  MbNb207cHopQC357-C425
QVQLVESGGGLVQTKTTTSVIDTTNDAQNLLTQAQTIVNTLKDYCPILIAKSSSSNGGTNNANTPSWQTAGGGKNSCATFGAEFSAASDMINNAQKIVQETQQLSANQPKNITQPHNLNLNSPSSLTALAQKMLKNAQSQAEILKLANQVESDFNKLSSGHLKDYIGKCDASAISSANMTMQNQKNNWGNGCAGVEETQSLLKTSAADFNNQTPQINQAQNLANTLIQELGNNPFRASGGGSGGGGSGKLSDTYEQLSRLLTNDNGTNSKTSAQAINQAVNNLNERAKTLAGGTTNSPAYQATLLALRSVLGLWNSMGYAVICGGYTKSPGENNQKDFHYTDENGNGTTINCGGSTCSNGTHSYNGTNTLKADKNVSLSIEQYEKIHEAYQILSKALKQAGLAPLNSKGEKLEAHVTTSKYGSLCLSCAASGRTFSTAAMGWFRQAPGKERDFVAGIYWTVGSTYYADSAKGRFTISRDNAKNTVYLQMDSLKPEDTAVYYCAARRRGFTLAPTRANEYDYWGQGTQVTVSSHHHHHHEPEA

SEQ ID NO: 49 - protein, 542 aa, Artificial Sequence
  MbNb207cHopQC358-C488
QVQLVESGGGLVQTKTTTSVIDTTNDAQNLLTQAQTIVNTLKDYCPILIAKSSSSNGGTNNANTPSWQTAGGGKNSCATFGAEFSAASDMINNAQKIVQETQQLSANQPKNITQPHNLNLNSPSSLTALAQKMLKNAQSQAEILKLANQVESDFNKLSSGHLKDYIGKCDASAISSANMTMQNQKNNWGNGCAGVEETQSLLKTSAADFNNQTPQINQAQNLANTLIQELGNNPFRASGGGSGGGGSGKLSDTYEQLSRLLTNDNGTNSKTSAQAINQAVNNLNERAKTLAGGTTNSPAYQATLLALRSVLGLWNSMGYAVICGGYTKSPGENNQKDFHYTDENGNGTTINCGGSTNCNGTHSYNGTNTLKADKNVSLSIEQYEKIHEAYQILSKALKQAGLAPLNSKGEKLEAHVTTSKYGSLRLSCAASGRTFSTAAMGWFRQAPGKERDFVAGIYWTVGSTYYADSAKGRFTISRDNAKNTVYLCMDSLKPEDTAVYYCAARRRGFTLAPTRANEYDYWGQGTQVTVSSHHHHHHEPEA

SEQ ID NO: 50 - protein, 542 aa, Artificial Sequence
  MbNb207cHopQC359-C490
QVQLVESGGGLVQTKTTTSVIDTTNDAQNLLTQAQTIVNTLKDYCPILIAKSSSSNGGTNNANTPSWQTAGGGKNSCATFGAEFSAASDMINNAQKIVQETQQLSANQPKNITQPHNLNLNSPSSLTALAQKMLKNAQSQAEILKLANQVESDFNKLSSGHLKDYIGKCDASAISSANMTMQNQKNNWGNGCAGVEETQSLLKTSAADFNNQTPQINQAQNLANTLIQELGNNPFRASGGGSGGGGSGKLSDTYEQLSRLLTNDNGTNSKTSAQAINQAVNNLNERAKTLAGGTTNSPAYQATLLALRSVLGLWNSMGYAVICGGYTKSPGENNQKDFHYTDENGNGTTINCGGSTNSCGTHSYNGTNTLKADKNVSLSIEQYEKIHEAYQILSKALKQAGLAPLNSKGEKLEAHVTTSKYGSLRLSCAASGRTFSTAAMGWFRQAPGKERDFVAGIYWTVGSTYYADSAKGRFTISRDNAKNTVYLQMCSLKPEDTAVYYCAARRRGFTLAPTRANEYDYWGQGTQVTVSSHHHHHHEPEA

SEQ ID NO: 51 - protein, 544 aa, Artificial Sequence
  MbNb207cHopQC15-C534
QVQLVESGGGLVQTCTTTSVIDTTNDAQNLLTQAQTIVNTLKDYCPILIAKSSSSNGGTNNANTPSWQTAGGGKNSCATFGAEFSAASDMINNAQKIVQETQQLSANQPKNITQPHNLNLNSPSSLTALAQKMLKNAQSQAEILKLANQVESDFNKLSSGHLKDYIGKCDASAISSANMTMQNQKNNWGNGCAGVEETQSLLKTSAADFNNQTPQINQAQNLANTLIQELGNNPFRASGGGSGGGGSGKLSDTYEQLSRLLTNDNGTNSKTSAQAINQAVNNLNERAKTLAGGTTNSPAYQATLLALRSVLGLWNSMGYAVICGGYTKSPGENNQKDFHYTDENGNGTTINCGGSTNSNGTHSYNGTNTLKADKNVSLSIEQYEKIHEAYQILSKALKQAGLAPLNSKGEKLEAHVTTSKYGSLRLSCAASGRTFSTAAMGWFRQAPGKERDFVAGIYWTVGSTYYADSAKGRFTISRDNAKNTVYLQMDSLKPEDTAVYYCAARRRGFTLAPTRANEYDYWGQGTQVTVSSGCHHHHHHEPEA

SEQ ID NO: 52 - protein, 128 aa, Artificial Sequence
  P.aeruginosa Azurin (PDB 2TSA) M121A mutant protein
AECSVDIQGNDQMQFNTNAITVDKSCKQFTVNLSHPGNLPKNVMGHNWVLSTAADMQGVVTDGMASGLDKDYLKPDDSRVIAHTKLIGSGEKDSVTFDVSKLKEGEQYMFFCTFPGHSALAKGTLTLK

SEQ ID NO: 53 - protein, 253 aa, Artificial Sequence
  MbNb207AzurinQrandomlinkers
  misc_feature (13)..(13): Xaa can be any naturally occurring amino acid
  misc_feature (34)..(34): Xaa can be any naturally occurring amino acid
  misc_feature (145)..(145): Xaa can be any naturally occurring amino acid
QVQLVESGGGLVXCSVDIQGNDQMQFNTNAITVXSLRLSCAASGRTFSTAAMGWFRQAPGKERDFVAGIYWTVGSTYYADSAKGRFTISRDNAKNTVYLQMDSLKPEDTAVYYCAARRRGFTLAPTRANEYDYWGQGTQVTVSSXVNLSHPGNLPKNVMGHNWVLSTAADMQGVVTDGMASGLDKDYLKPDDSRVIAHTKLIGSGEKDSVTFDVSKLKEGEQYMFFCTFPGHSALAKGTLTLKHHHHHHEPEA

SEQ ID NO: 54 - protein, 254 aa, Artificial Sequence
  MbNb207AzurinQrandomlinkers
  misc_feature (13)..(14): Xaa can be any naturally occurring amino acid
  misc_feature (35)..(35): Xaa can be any naturally occurring amino acid
  misc_feature (146)..(146): Xaa can be any naturally occurring amino acid
QVQLVESGGGLVXXCSVDIQGNDQMQFNTNAITVXSLRLSCAASGRTFSTAAMGWFRQAPGKERDFVAGIYWTVGSTYYADSAKGRFTISRDNAKNTVYLQMDSLKPEDTAVYYCAARRRGFTLAPTRANEYDYWGQGTQVTVSSXVNLSHPGNLPKNVMGHNWVLSTAADMQGVVTDGMASGLDKDYLKPDDSRVIAHTKLIGSGEKDSVTFDVSKLKEGEQYMFFCTFPGHSALAKGTLTLKHHHHHHEPEA

SEQ ID NO: 55 - protein, 254 aa, Artificial Sequence
  MbNb207AzurinQrandomlinkers
  misc_feature (13)..(13): Xaa can be any naturally occurring amino acid
  misc_feature (34)..(35): Xaa can be any naturally occurring amino acid
  misc_feature (146)..(146): Xaa can be any naturally occurring amino acid
QVQLVESGGGLVXCSVDIQGNDQMQFNTNAITVXXSLRLSCAASGRTFSTAAMGWFRQAPGKERDFVAGIYWTVGSTYYADSAKGRFTISRDNAKNTVYLQMDSLKPEDTAVYYCAARRRGFTLAPTRANEYDYWGQGTQVTVSSXVNLSHPGNLPKNVMGHNWVLSTAADMQGVVTDGMASGLDKDYLKPDDSRVIAHTKLIGSGEKDSVTFDVSKLKEGEQYMFFCTFPGHSALAKGTLTLKHHHHHHEPEA

SEQ ID NO: 56 - protein, 254 aa, Artificial Sequence
  MbNb207AzurinQrandomlinkers
  misc_feature (13)..(13): Xaa can be any naturally occurring amino acid
  misc_feature (34)..(34): Xaa can be any naturally occurring amino acid
  misc_feature (145)..(146): Xaa can be any naturally occurring amino acid
QVQLVESGGGLVXCSVDIQGNDQMQFNTNAITVXSLRLSCAASGRTFSTAAMGWFRQAPGKERDFVAGIYWTVGSTYYADSAKGRFTISRDNAKNTVYLQMDSLKPEDTAVYYCAARRRGFTLAPTRANEYDYWGQGTQVTVSSXXVNLSHPGNLPKNVMGHNWVLSTAADMQGVVTDGMASGLDKDYLKPDDSRVIAHTKLIGSGEKDSVTFDVSKLKEGEQYMFFCTFPGHSALAKGTLTLKHHHHHHEPEA

SEQ ID NO: 57 - protein, 255 aa, Artificial Sequence
  MbNb207AzurinQrandomlinkers
  misc_feature (13)..(13): Xaa can be any naturally occurring amino acid
  misc_feature (34)..(35): Xaa can be any naturally occurring amino acid
  misc_feature (146)..(147): Xaa can be any naturally occurring amino acid
QVQLVESGGGLVXCSVDIQGNDQMQFNTNAITVXXSLRLSCAASGRTFSTAAMGWFRQAPGKERDFVAGIYWTVGSTYYADSAKGRFTISRDNAKNTVYLQMDSLKPEDTAVYYCAARRRGFTLAPTRANEYDYWGQGTQVTVSSXXVNLSHPGNLPKNVMGHNWVLSTAADMQGVVTDGMASGLDKDYLKPDDSRVIAHTKLIGSGEKDSVTFDVSKLKEGEQYMFFCTFPGHSALAKGTLTLKHHHHHHEPEA

SEQ ID NO: 58 - protein, 255 aa, Artificial Sequence
  MbNb207AzurinQrandomlinkers
  misc_feature (13)..(14): Xaa can be any naturally occurring amino acid
  misc_feature (35)..(35): Xaa can be any naturally occurring amino acid
  misc_feature (146)..(147): Xaa can be any naturally occurring amino acid
QVQLVESGGGLVXXCSVDIQGNDQMQFNTNAITVXSLRLSCAASGRTFSTAAMGWFRQAPGKERDFVAGIYWTVGSTYYADSAKGRFTISRDNAKNTVYLQMDSLKPEDTAVYYCAARRRGFTLAPTRANEYDYWGQGTQVTVSSXXVNLSHPGNLPKNVMGHNWVLSTAADMQGVVTDGMASGLDKDYLKPDDSRVIAHTKLIGSGEKDSVTFDVSKLKEGEQYMFFCTFPGHSALAKGTLTLKHHHHHHEPEA

SEQ ID NO: 59 - protein, 255 aa, Artificial Sequence
  MbNb207AzurinQrandomlinkers
  misc_feature (13)..(14): Xaa can be any naturally occurring amino acid
  misc_feature (35)..(36): Xaa can be any naturally occurring amino acid
  misc_feature (147)..(147): Xaa can be any naturally occurring amino acid
QVQLVESGGGLVXXCSVDIQGNDQMQFNTNAITVXXSLRLSCAASGRTFSTAAMGWFRQAPGKERDFVAGIYWTVGSTYYADSAKGRFTISRDNAKNTVYLQMDSLKPEDTAVYYCAARRRGFTLAPTRANEYDYWGQGTQVTVSSXVNLSHPGNLPKNVMGHNWVLSTAADMQGVVTDGMASGLDKDYLKPDDSRVIAHTKLIGSGEKDSVTFDVSKLKEGEQYMFFCTFPGHSALAKGTLTLKHHHHHHEPEA

SEQ ID NO: 60 - protein, 256 aa, Artificial Sequence
  MbNb207AzurinQrandomlinkers
  misc_feature (13)..(14): Xaa can be any naturally occurring amino acid
  misc_feature (35)..(36): Xaa can be any naturally occurring amino acid
  misc_feature (147)..(148): Xaa can be any naturally occurring amino acid
QVQLVESGGGLVXXCSVDIQGNDQMQFNTNAITVXXSLRLSCAASGRTFSTAAMGWFRQAPGKERDFVAGIYWTVGSTYYADSAKGRFTISRDNAKNTVYLQMDSLKPEDTAVYYCAARRRGFTLAPTRANEYDYWGQGTQVTVSSXXVNLSHPGNLPKNVMGHNWVLSTAADMQGVVTDGMASGLDKDYLKPDDSRVIAHTKLIGSGEKDSVTFDVSKLKEGEQYMFFCTFPGHSALAKGTLTLKHHHHHHEPEA

SEQ ID NO: 61 - protein, 533 aa, Artificial Sequence
  MbNb207AzurinQconnection library_Aga2p_ACP protein sequence
  misc_feature (102)..(102): Xaa can be any naturally occurring amino acid
  misc_feature (123)..(123): Xaa can be any naturally occurring amino acid
  misc_feature (234)..(234): Xaa can be any naturally occurring amino acid
MRFPSIFTAVVFAASSALAAPANTTAEDETAQIPAEAVIGYLGLEGDSDVAALPLSDSTNNGSLSTNTTIASIAAKEEGVQLDKREAEAQVQLVESGGGLVXCSVDIQGNDQMQFNTNAITVXSLRLSCAASGRTFSTAAMGWFRQAPGKERDFVAGIYWTVGSTYYADSAKGRFTISRDNAKNTVYLQMDSLKPEDTAVYYCAARRRGFTLAPTRANEYDYWGQGTQVTVSSXVNLSHPGNLPKNVMGHNWVLSTAADMQGVVTDGMASGLDKDYLKPDDSRVIAHTKLIGSGEKDSVTFDVSKLKEGEQYMFFCTFPGHSALAKGTLTLKSLGGGSGGGGSGGGGSGGGGSGGGGSGGGGSGGGGSQELTTICEQIPSPTLESTPYSLSTTTILANGKAMQGVFEYYKSVTFVSNCGSHPSTTSKGSPINTQYVFKDNSSTSMSTIEERVKKIIGEQLGVKQEEVTNNASFVEDLGADSLDTVELVMALEEEFDTEIPDEEAEKITTVQAAIDYINGHQASEQKLISEEDL

SEQ ID NO: 62 - protein, 534 aa, Artificial Sequence
  MbNb207AzurinQconnection library_Aga2p_ACP protein sequence
  misc_feature (102)..(103): Xaa can be any naturally occurring amino acid
  misc_feature (124)..(124): Xaa can be any naturally occurring amino acid
  misc_feature (235)..(235): Xaa can be any naturally occurring amino acid
MRFPSIFTAVVFAASSALAAPANTTAEDETAQIPAEAVIGYLGLEGDSDVAALPLSDSTNNGSLSTNTTIASIAAKEEGVQLDKREAEAQVQLVESGGGLVXXCSVDIQGNDQMQFNTNAITVXSLRLSCAASGRTFSTAAMGWFRQAPGKERDFVAGIYWTVGSTYYADSAKGRFTISRDNAKNTVYLQMDSLKPEDTAVYYCAARRRGFTLAPTRANEYDYWGQGTQVTVSSXVNLSHPGNLPKNVMGHNWVLSTAADMQGVVTDGMASGLDKDYLKPDDSRVIAHTKLIGSGEKDSVTFDVSKLKEGEQYMFFCTFPGHSALAKGTLTLKSLGGGSGGGGSGGGGSGGGGSGGGGSGGGGSGGGGSQELTTICEQIPSPTLESTPYSLSTTTILANGKAMQGVFEYYKSVTFVSNCGSHPSTTSKGSPINTQYVFKDNSSTSMSTIEERVKKIIGEQLGVKQEEVTNNASFVEDLGADSLDTVELVMALEEEFDTEIPDEEAEKITTVQAAIDYINGHQASEQKLISEEDL

SEQ ID NO: 63 - protein, 534 aa, Artificial Sequence
  MbNb207AzurinQconnection library_Aga2p_ACP protein sequence
  misc_feature (102)..(102): Xaa can be any naturally occurring amino acid
  misc_feature (123)..(124): Xaa can be any naturally occurring amino acid
  misc_feature (235)..(235): Xaa can be any naturally occurring amino acid
MRFPSIFTAVVFAASSALAAPANTTAEDETAQIPAEAVIGYLGLEGDSDVAALPLSDSTNNGSLSTNTTIASIAAKEEGVQLDKREAEAQVQLVESGGGLVXCSVDIQGNDQMQFNTNAITVXXSLRLSCAASGRTFSTAAMGWFRQAPGKERDFVAGIYWTVGSTYYADSAKGRFTISRDNAKNTVYLQMDSLKPEDTAVYYCAARRRGFTLAPTRANEYDYWGQGTQVTVSSXVNLSHPGNLPKNVMGHNWVLSTAADMQGVVTDGMASGLDKDYLKPDDSRVIAHTKLIGSGEKDSVTFDVSKLKEGEQYMFFCTFPGHSALAKGTLTLKSLGGGSGGGGSGGGGSGGGGSGGGGSGGGGSGGGGSQELTTICEQIPSPTLESTPYSLSTTTILANGKAMQGVFEYYKSVTFVSNCGSHPSTTSKGSPINTQYVFKDNSSTSMSTIEERVKKIIGEQLGVKQEEVTNNASFVEDLGADSLDTVELVMALEEEFDTEIPDEEAEKITTVQAAIDYINGHQASEQKLISEEDL

SEQ ID NO: 64 - protein, 534 aa, Artificial Sequence
  MbNb207AzurinQconnection library_Aga2p_ACP protein sequence
  misc_feature (102)..(102): Xaa can be any naturally occurring amino acid
  misc_feature (123)..(123): Xaa can be any naturally occurring amino acid
  misc_feature (234)..(235): Xaa can be any naturally occurring amino acid
MRFPSIFTAVVFAASSALAAPANTTAEDETAQIPAEAVIGYLGLEGDSDVAALPLSDSTNNGSLSTNTTIASIAAKEEGVQLDKREAEAQVQLVESGGGLVXCSVDIQGNDQMQFNTNAITVXSLRLSCAASGRTFSTAAMGWFRQAPGKERDFVAGIYWTVGSTYYADSAKGRFTISRDNAKNTVYLQMDSLKPEDTAVYYCAARRRGFTLAPTRANEYDYWGQGTQVTVSSXXVNLSHPGNLPKNVMGHNWVLSTAADMQGVVTDGMASGLDKDYLKPDDSRVIAHTKLIGSGEKDSVTFDVSKLKEGEQYMFFCTFPGHSALAKGTLTLKSLGGGSGGGGSGGGGSGGGGSGGGGSGGGGSGGGGSQELTTICEQIPSPTLESTPYSLSTTTILANGKAMQGVFEYYKSVTFVSNCGSHPSTTSKGSPINTQYVFKDNSSTSMSTIEERVKKIIGEQLGVKQEEVTNNASFVEDLGADSLDTVELVMALEEEFDTEIPDEEAEKITTVQAAIDYINGHQASEQKLISEEDL

SEQ ID NO: 65 - protein, 535 aa, Artificial Sequence
  MbNb207AzurinQconnection library_Aga2p_ACP protein sequence
  misc_feature (102)..(102): Xaa can be any naturally occurring amino acid
  misc_feature (123)..(124): Xaa can be any naturally occurring amino acid
  misc_feature (235)..(236): Xaa can be any naturally occurring amino acid
MRFPSIFTAVVFAASSALAAPANTTAEDETAQIPAEAVIGYLGLEGDSDVAALPLSDSTNNGSLSTNTTIASIAAKEEGVQLDKREAEAQVQLVESGGGLVXCSVDIQGNDQMQFNTNAITVXXSLRLSCAASGRTFSTAAMGWFRQAPGKERDFVAGIYWTVGSTYYADSAKGRFTISRDNAKNTVYLQMDSLKPEDTAVYYCAARRRGFTLAPTRANEYDYWGQGTQVTVSSXXVNLSHPGNLPKNVMGHNWVLSTAADMQGVVTDGMASGLDKDYLKPDDSRVIAHTKLIGSGEKDSVTFDVSKLKEGEQYMFFCTFPGHSALAKGTLTLKSLGGGSGGGGSGGGGSGGGGSGGGGSGGGGSGGGGSQELTTICEQIPSPTLESTPYSLSTTTILANGKAMQGVFEYYKSVTFVSNCGSHPSTTSKGSPINTQYVFKDNSSTSMSTIEERVKKIIGEQLGVKQEEVTNNASFVEDLGADSLDTVELVMALEEEFDTEIPDEEAEKITTVQAAIDYINGHQASEQKLISEEDL

SEQ ID NO: 66 - protein, 535 aa, Artificial Sequence
  MbNb207AzurinQconnection library_Aga2p_ACP protein sequence
  misc_feature (102)..(103): Xaa can be any naturally occurring amino acid
  misc_feature (124)..(124): Xaa can be any naturally occurring amino acid
  misc_feature (235)..(236): Xaa can be any naturally occurring amino acid
MRFPSIFTAVVFAASSALAAPANTTAEDETAQIPAEAVIGYLGLEGDSDVAALPLSDSTNNGSLSTNTTIASIAAKEEGVQLDKREAEAQVQLVESGGGLVXXCSVDIQGNDQMQFNTNAITVXSLRLSCAASGRTFSTAAMGWFRQAPGKERDFVAGIYWTVGSTYYADSAKGRFTISRDNAKNTVYLQMDSLKPEDTAVYYCAARRRGFTLAPTRANEYDYWGQGTQVTVSSXXVNLSHPGNLPKNVMGHNWVLSTAADMQGVVTDGMASGLDKDYLKPDDSRVIAHTKLIGSGEKDSVTFDVSKLKEGEQYMFFCTFPGHSALAKGTLTLKSLGGGSGGGGSGGGGSGGGGSGGGGSGGGGSGGGGSQELTTICEQIPSPTLESTPYSLSTTTILANGKAMQGVFEYYKSVTFVSNCGSHPSTTSKGSPINTQYVFKDNSSTSMSTIEERVKKIIGEQLGVKQEEVTNNASFVEDLGADSLDTVELVMALEEEFDTEIPDEEAEKITTVQAAIDYINGHQASEQKLISEEDL

SEQ ID NO: 67 - protein, 535 aa, Artificial Sequence
  MbNb207AzurinQconnection library_Aga2p_ACP protein sequence
  misc_feature (102)..(103): Xaa can be any naturally occurring amino acid
  misc_feature (124)..(125): Xaa can be any naturally occurring amino acid
  misc_feature (236)..(236): Xaa can be any naturally occurring amino acid
MRFPSIFTAVVFAASSALAAPANTTAEDETAQIPAEAVIGYLGLEGDSDVAALPLSDSTNNGSLSTNTTIASIAAKEEGVQLDKREAEAQVQLVESGGGLVXXCSVDIQGNDQMQFNTNAITVXXSLRLSCAASGRTFSTAAMGWFRQAPGKERDFVAGIYWTVGSTYYADSAKGRFTISRDNAKNTVYLQMDSLKPEDTAVYYCAARRRGFTLAPTRANEYDYWGQGTQVTVSSXVNLSHPGNLPKNVMGHNWVLSTAADMQGVVTDGMASGLDKDYLKPDDSRVIAHTKLIGSGEKDSVTFDVSKLKEGEQYMFFCTFPGHSALAKGTLTLKSLGGGSGGGGSGGGGSGGGGSGGGGSGGGGSGGGGSQELTTICEQIPSPTLESTPYSLSTTTILANGKAMQGVFEYYKSVTFVSNCGSHPSTTSKGSPINTQYVFKDNSSTSMSTIEERVKKIIGEQLGVKQEEVTNNASFVEDLGADSLDTVELVMALEEEFDTEIPDEEAEKITTVQAAIDYINGHQASEQKLISEEDL

SEQ ID NO: 68 - protein, 536 aa, Artificial Sequence
  MbNb207AzurinQconnection library_Aga2p_ACP protein sequence
  misc_feature (102)..(103): Xaa can be any naturally occurring amino acid
  misc_feature (124)..(125): Xaa can be any naturally occurring amino acid
  misc_feature (236)..(237): Xaa can be any naturally occurring amino acid
MRFPSIFTAVVFAASSALAAPANTTAEDETAQIPAEAVIGYLGLEGDSDVAALPLSDSTNNGSLSTNTTIASIAAKEEGVQLDKREAEAQVQLVESGGGLVXXCSVDIQGNDQMQFNTNAITVXXSLRLSCAASGRTFSTAAMGWFRQAPGKERDFVAGIYWTVGSTYYADSAKGRFTISRDNAKNTVYLQMDSLKPEDTAVYYCAARRRGFTLAPTRANEYDYWGQGTQVTVSSXXVNLSHPGNLPKNVMGHNWVLSTAADMQGVVTDGMASGLDKDYLKPDDSRVIAHTKLIGSGEKDSVTFDVSKLKEGEQYMFFCTFPGHSALAKGTLTLKSLGGGSGGGGSGGGGSGGGGSGGGGSGGGGSGGGGSQELTTICEQIPSPTLESTPYSLSTTTILANGKAMQGVFEYYKSVTFVSNCGSHPSTTSKGSPINTQYVFKDNSSTSMSTIEERVKKIIGEQLGVKQEEVTNNASFVEDLGADSLDTVELVMALEEEFDTEIPDEEAEKITTVQAAIDYINGHQASEQKLISEEDL

SEQ ID NO: 69 - protein, 726 aa, Bacteroides thetaiotaomicron
MQQKLTSPDNNLVMTFQVDSKGAPTYELTYKNKVVIKPSTLGLELKKEDNTRTDFDWVDRRDLTKLDSKTNLYDGFEVKDTQTATFDETWQPVWGEEKEIRNHYNELAVTLYQPMNDRSIVIRFRLFNDGLGFRYEFPQQKSLNYFVIKEEHSQFGMNGDHIAFWIPGDYDTQEYDYTISRLSEIRGLMKEAITPNSSQTPFSQTGVQTALMMKTDDGLYINLHEAALVDYSCMHLNLDDKNMVFESWLTPDAKGDKGYMQTPCNTPWRTIIVSDDARNILASRITLNLNEPCKIADAASWVKPVKYIGVWWDMITGKGSWAYTDELTSVKLGETDYSKTKPNGKHSANTANVKRYIDFAAAHGFDAVLVEGWNEGWEDWFGNSKDYVFDFVTPYPDFDVKEIHRYAARKGIKMMMHHETSASVRNYERHMDKAYQFMADNGYNSVKSGYVGNIIPRGEHHYGQWMNNHYLYAVKKAADYKIMVNAHEATRPTGICRTYPNLIGNESARGTEYESFGGNKVYHTTILPFTRLVGGPMDYTPGIFETHCNKMNPANNSQVRSTIARQLALYVTMYSPLQMAADIPENYERFMDAFQFIKDVALDWDETNYLEAEPGEYITIARKAKDTDDWYVGCTAGENGHTSKLVFDFLTPGKQYIATVYADAKDADWKENPQAYTIKKGILTNKSKLNLHAANGGGYAISIKEVKDKSEAKGLKRLLEHHHHHH

SEQ ID NO: 70 - protein, 850 aa, Artificial Sequence
  MbNb207SusBrandomlinkers Megabody library protein sequences
  misc_feature (16)..(16): Xaa can be any naturally occurring amino acid
  misc_feature (85)..(85): Xaa can be any naturally occurring amino acid
  misc_feature (197)..(197): Xaa can be any naturally occurring amino acid
QVQLVESGGGLVQASXMQQKLTSPDNNLVMTFQVDSKGAPTYELTYKNKVVIKPSTLGLELKKEDNTRTDFDWVDRRDLTKLDSXGGSLRLSCAASGRTFSTAAMGWFRQAPGKERDFVAGIYWTVGSTYYADSAKGRFTISRDNAKNTVYLQMDSLKPEDTAVYYCAARRRGFTLAPTRANEYDYWGQGTQVTVSXFEVKDTQTATFDETWQPVWGEEKEIRNHYNELAVTLYQPMNDRSIVIRFRLFNDGLGFRYEFPQQKSLNYFVIKEEHSQFGMNGDHIAFWIPGDYDTQEYDYTISRLSEIRGLMKEAITPNSSQTPFSQTGVQTALMMKTDDGLYINLHEAALVDYSCMHLNLDDKNMVFESWLTPDAKGDKGYMQTPCNTPWRTIIVSDDARNILASRITLNLNEPCKIADAASWVKPVKYIGVWWDMITGKGSWAYTDELTSVKLGETDYSKTKPNGKHSANTANVKRYIDFAAAHGFDAVLVEGWNEGWEDWFGNSKDYVFDFVTPYPDFDVKEIHRYAARKGIKMMMHHETSASVRNYERHMDKAYQFMADNGYNSVKSGYVGNIIPRGEHHYGQWMNNHYLYAVKKAADYKIMVNAHEATRPTGICRTYPNLIGNESARGTEYESFGGNKVYHTTILPFTRLVGGPMDYTPGIFETHCNKMNPANNSQVRSTIARQLALYVTMYSPLQMAADIPENYERFMDAFQFIKDVALDWDETNYLEAEPGEYITIARKAKDTDDWYVGCTAGENGHTSKLVFDFLTPGKQYIATVYADAKDADWKENPQAYTIKKGILTNKSKLNLHAANGGGYAISIKEVKDKSEAKGLKRLHHHHHHEPEA

SEQ ID NO: 71 - protein, 851 aa, Artificial Sequence
  MbNb207SusBrandomlinkers Megabody library protein sequences
  misc_feature (16)..(17): Xaa can be any naturally occurring amino acid
  misc_feature (86)..(86): Xaa can be any naturally occurring amino acid
  misc_feature (198)..(198): Xaa can be any naturally occurring amino acid
QVQLVESGGGLVQASXXMQQKLTSPDNNLVMTFQVDSKGAPTYELTYKNKVVIKPSTLGLELKKEDNTRTDFDWVDRRDLTKLDSXGGSLRLSCAASGRTFSTAAMGWFRQAPGKERDFVAGIYWTVGSTYYADSAKGRFTISRDNAKNTVYLQMDSLKPEDTAVYYCAARRRGFTLAPTRANEYDYWGQGTQVTVSXFEVKDTQTATFDETWQPVWGEEKEIRNHYNELAVTLYQPMNDRSIVIRFRLFNDGLGFRYEFPQQKSLNYFVIKEEHSQFGMNGDHIAFWIPGDYDTQEYDYTISRLSEIRGLMKEAITPNSSQTPFSQTGVQTALMMKTDDGLYINLHEAALVDYSCMHLNLDDKNMVFESWLTPDAKGDKGYMQTPCNTPWRTIIVSDDARNILASRITLNLNEPCKIADAASWVKPVKYIGVWWDMITGKGSWAYTDELTSVKLGETDYSKTKPNGKHSANTANVKRYIDFAAAHGFDAVLVEGWNEGWEDWFGNSKDYVFDFVTPYPDFDVKEIHRYAARKGIKMMMHHETSASVRNYERHMDKAYQFMADNGYNSVKSGYVGNIIPRGEHHYGQWMNNHYLYAVKKAADYKIMVNAHEATRPTGICRTYPNLIGNESARGTEYESFGGNKVYHTTILPFTRLVGGPMDYTPGIFETHCNKMNPANNSQVRSTIARQLALYVTMYSPLQMAADIPENYERFMDAFQFIKDVALDWDETNYLEAEPGEYITIARKAKDTDDWYVGCTAGENGHTSKLVFDFLTPGKQYIATVYADAKDADWKENPQAYTIKKGILTNKSKLNLHAANGGGYAISIKEVKDKSEAKGLKRLHHHHHHEPEA

SEQ ID NO: 72 - protein, 851 aa, Artificial Sequence
  MbNb207SusBrandomlinkers Megabody library protein sequences
  misc_feature (16)..(16): Xaa can be any naturally occurring amino acid
  misc_feature (85)..(86): Xaa can be any naturally occurring amino acid
  misc_feature (198)..(198): Xaa can be any naturally occurring amino acid
QVQLVESGGGLVQASXMQQKLTSPDNNLVMTFQVDSKGAPTYELTYKNKVVIKPSTLGLELKKEDNTRTDFDWVDRRDLTKLDSXXGGSLRLSCAASGRTFSTAAMGWFRQAPGKERDFVAGIYWTVGSTYYADSAKGRFTISRDNAKNTVYLQMDSLKPEDTAVYYCAARRRGFTLAPTRANEYDYWGQGTQVTVSXFEVKDTQTATFDETWQPVWGEEKEIRNHYNELAVTLYQPMNDRSIVIRFRLFNDGLGFRYEFPQQKSLNYFVIKEEHSQFGMNGDHIAFWIPGDYDTQEYDYTISRLSEIRGLMKEAITPNSSQTPFSQTGVQTALMMKTDDGLYINLHEAALVDYSCMHLNLDDKNMVFESWLTPDAKGDKGYMQTPCNTPWRTIIVSDDARNILASRITLNLNEPCKIADAASWVKPVKYIGVWWDMITGKGSWAYTDELTSVKLGETDYSKTKPNGKHSANTANVKRYIDFAAAHGFDAVLVEGWNEGWEDWFGNSKDYVFDFVTPYPDFDVKEIHRYAARKGIKMMMHHETSASVRNYERHMDKAYQFMADNGYNSVKSGYVGNIIPRGEHHYGQWMNNHYLYAVKKAADYKIMVNAHEATRPTGICRTYPNLIGNESARGTEYESFGGNKVYHTTILPFTRLVGGPMDYTPGIFETHCNKMNPANNSQVRSTIARQLALYVTMYSPLQMAADIPENYERFMDAFQFIKDVALDWDETNYLEAEPGEYITIARKAKDTDDWYVGCTAGENGHTSKLVFDFLTPGKQYIATVYADAKDADWKENPQAYTIKKGILTNKSKLNLHAANGGGYAISIKEVKDKSEAKGLKRLHHHHHHEPEA

SEQ ID NO: 73 - protein, 851 aa, Artificial Sequence
  MbNb207SusBrandomlinkers Megabody library protein sequences
  misc_feature (16)..(16): Xaa can be any naturally occurring amino acid
  misc_feature (85)..(85): Xaa can be any naturally occurring amino acid
  misc_feature (197)..(198): Xaa can be any naturally occurring amino acid
QVQLVESGGGLVQASXMQQKLTSPDNNLVMTFQVDSKGAPTYELTYKNKVVIKPSTLGLELKKEDNTRTDFDWVDRRDLTKLDSXGGSLRLSCAASGRTFSTAAMGWFRQAPGKERDFVAGIYWTVGSTYYADSAKGRFTISRDNAKNTVYLQMDSLKPEDTAVYYCAARRRGFTLAPTRANEYDYWGQGTQVTVSXXFEVKDTQTATFDETWQPVWGEEKEIRNHYNELAVTLYQPMNDRSIVIRFRLFNDGLGFRYEFPQQKSLNYFVIKEEHSQFGMNGDHIAFWIPGDYDTQEYDYTISRLSEIRGLMKEAITPNSSQTPFSQTGVQTALMMKTDDGLYINLHEAALVDYSCMHLNLDDKNMVFESWLTPDAKGDKGYMQTPCNTPWRTIIVSDDARNILASRITLNLNEPCKIADAASWVKPVKYIGVWWDMITGKGSWAYTDELTSVKLGETDYSKTKPNGKHSANTANVKRYIDFAAAHGFDAVLVEGWNEGWEDWFGNSKDYVFDFVTPYPDFDVKEIHRYAARKGIKMMMHHETSASVRNYERHMDKAYQFMADNGYNSVKSGYVGNIIPRGEHHYGQWMNNHYLYAVKKAADYKIMVNAHEATRPTGICRTYPNLIGNESARGTEYESFGGNKVYHTTILPFTRLVGGPMDYTPGIFETHCNKMNPANNSQVRSTIARQLALYVTMYSPLQMAADIPENYERFMDAFQFIKDVALDWDETNYLEAEPGEYITIARKAKDTDDWYVGCTAGENGHTSKLVFDFLTPGKQYIATVYADAKDADWKENPQAYTIKKGILTNKSKLNLHAANGGGYAISIKEVKDKSEAKGLKRLHHHHHHEPEA

SEQ ID NO: 74 - protein, 852 aa, Artificial Sequence
  MbNb207SusBrandomlinkers Megabody library protein sequences
  misc_feature (16)..(16): Xaa can be any naturally occurring amino acid
  misc_feature (85)..(86): Xaa can be any naturally occurring amino acid
  misc_feature (198)..(199): Xaa can be any naturally occurring amino acid
QVQLVESGGGLVQASXMQQKLTSPDNNLVMTFQVDSKGAPTYELTYKNKVVIKPSTLGLELKKEDNTRTDFDWVDRRDLTKLDSXXGGSLRLSCAASGRTFSTAAMGWFRQAPGKERDFVAGIYWTVGSTYYADSAKGRFTISRDNAKNTVYLQMDSLKPEDTAVYYCAARRRGFTLAPTRANEYDYWGQGTQVTVSXXFEVKDTQTATFDETWQPVWGEEKEIRNHYNELAVTLYQPMNDRSIVIRFRLFNDGLGFRYEFPQQKSLNYFVIKEEHSQFGMNGDHIAFWIPGDYDTQEYDYTISRLSEIRGLMKEAITPNSSQTPFSQTGVQTALMMKTDDGLYINLHEAALVDYSCMHLNLDDKNMVFESWLTPDAKGDKGYMQTPCNTPWRTIIVSDDARNILASRITLNLNEPCKIADAASWVKPVKYIGVWWDMITGKGSWAYTDELTSVKLGETDYSKTKPNGKHSANTANVKRYIDFAAAHGFDAVLVEGWNEGWEDWFGNSKDYVFDFVTPYPDFDVKEIHRYAARKGIKMMMHHETSASVRNYERHMDKAYQFMADNGYNSVKSGYVGNIIPRGEHHYGQWMNNHYLYAVKKAADYKIMVNAHEATRPTGICRTYPNLIGNESARGTEYESFGGNKVYHTTILPFTRLVGGPMDYTPGIFETHCNKMNPANNSQVRSTIARQLALYVTMYSPLQMAADIPENYERFMDAFQFIKDVALDWDETNYLEAEPGEYITIARKAKDTDDWYVGCTAGENGHTSKLVFDFLTPGKQYIATVYADAKDADWKENPQAYTIKKGILTNKSKLNLHAANGGGYAISIKEVKDKSEAKGLKRLHHHHHHEPEA

SEQ ID NO: 75 - protein, 852 aa, Artificial Sequence
  MbNb207SusBrandomlinkers Megabody library protein sequences
  misc_feature (16)..(17): Xaa can be any naturally occurring amino acid
  misc_feature (86)..(86): Xaa can be any naturally occurring amino acid
  misc_feature (198)..(199): Xaa can be any naturally occurring amino acid
QVQLVESGGGLVQASXXMQQKLTSPDNNLVMTFQVDSKGAPTYELTYKNKVVIKPSTLGLELKKEDNTRTDFDWVDRRDLTKLDSXGGSLRLSCAASGRTFSTAAMGWFRQAPGKERDFVAGIYWTVGSTYYADSAKGRFTISRDNAKNTVYLQMDSLKPEDTAVYYCAARRRGFTLAPTRANEYDYWGQGTQVTVSXXFEVKDTQTATFDETWQPVWGEEKEIRNHYNELAVTLYQPMNDRSIVIRFRLFNDGLGFRYEFPQQKSLNYFVIKEEHSQFGMNGDHIAFWIPGDYDTQEYDYTISRLSEIRGLMKEAITPNSSQTPFSQTGVQTALMMKTDDGLYINLHEAALVDYSCMHLNLDDKNMVFESWLTPDAKGDKGYMQTPCNTPWRTIIVSDDARNILASRITLNLNEPCKIADAASWVKPVKYIGVWWDMITGKGSWAYTDELTSVKLGETDYSKTKPNGKHSANTANVKRYIDFAAAHGFDAVLVEGWNEGWEDWFGNSKDYVFDFVTPYPDFDVKEIHRYAARKGIKMMMHHETSASVRNYERHMDKAYQFMADNGYNSVKSGYVGNIIPRGEHHYGQWMNNHYLYAVKKAADYKIMVNAHEATRPTGICRTYPNLIGNESARGTEYESFGGNKVYHTTILPFTRLVGGPMDYTPGIFETHCNKMNPANNSQVRSTIARQLALYVTMYSPLQMAADIPENYERFMDAFQFIKDVALDWDETNYLEAEPGEYITIARKAKDTDDWYVGCTAGENGHTSKLVFDFLTPGKQYIATVYADAKDADWKENPQAYTIKKGILTNKSKLNLHAANGGGYAISIKEVKDKSEAKGLKRLHHHHHHEPEA

SEQ ID NO: 76 - protein, 852 aa, Artificial Sequence
  MbNb207SusBrandomlinkers Megabody library protein sequences
  misc_feature (16)..(17): Xaa can be any naturally occurring amino acid
  misc_feature (86)..(87): Xaa can be any naturally occurring amino acid
  misc_feature (199)..(199): Xaa can be any naturally occurring amino acid
QVQLVESGGGLVQASXXMQQKLTSPDNNLVMTFQVDSKGAPTYELTYKNKVVIKPSTLGLELKKEDNTRTDFDWVDRRDLTKLDSXXGGSLRLSCAASGRTFSTAAMGWFRQAPGKERDFVAGIYWTVGSTYYADSAKGRFTISRDNAKNTVYLQMDSLKPEDTAVYYCAARRRGFTLAPTRANEYDYWGQGTQVTVSXFEVKDTQTATFDETWQPVWGEEKEIRNHYNELAVTLYQPMNDRSIVIRFRLFNDGLGFRYEFPQQKSLNYFVIKEEHSQFGMNGDHIAFWIPGDYDTQEYDYTISRLSEIRGLMKEAITPNSSQTPFSQTGVQTALMMKTDDGLYINLHEAALVDYSCMHLNLDDKNMVFESWLTPDAKGDKGYMQTPCNTPWRTIIVSDDARNILASRITLNLNEPCKIADAASWVKPVKYIGVWWDMITGKGSWAYTDELTSVKLGETDYSKTKPNGKHSANTANVKRYIDFAAAHGFDAVLVEGWNEGWEDWFGNSKDYVFDFVTPYPDFDVKEIHRYAARKGIKMMMHHETSASVRNYERHMDKAYQFMADNGYNSVKSGYVGNIIPRGEHHYGQWMNNHYLYAVKKAADYKIMVNAHEATRPTGICRTYPNLIGNESARGTEYESFGGNKVYHTTILPFTRLVGGPMDYTPGIFETHCNKMNPANNSQVRSTIARQLALYVTMYSPLQMAADIPENYERFMDAFQFIKDVALDWDETNYLEAEPGEYITIARKAKDTDDWYVGCTAGENGHTSKLVFDFLTPGKQYIATVYADAKDADWKENPQAYTIKKGILTNKSKLNLHAANGGGYAISIKEVKDKSEAKGLKRLHHHHHHEPEA

SEQ ID NO: 77 - protein, 853 aa, Artificial Sequence
  MbNb207SusBrandomlinkers Megabody library protein sequences
  misc_feature (16)..(17): Xaa can be any naturally occurring amino acid
  misc_feature (86)..(87): Xaa can be any naturally occurring amino acid
  misc_feature (199)..(200): Xaa can be any naturally occurring amino acid
QVQLVESGGGLVQASXXMQQKLTSPDNNLVMTFQVDSKGAPTYELTYKNKVVIKPSTLGLELKKEDNTRTDFDWVDRRDLTKLDSXXGGSLRLSCAASGRTFSTAAMGWFRQAPGKERDFVAGIYWTVGSTYYADSAKGRFTISRDNAKNTVYLQMDSLKPEDTAVYYCAARRRGFTLAPTRANEYDYWGQGTQVTVSXXFEVKDTQTATFDETWQPVWGEEKEIRNHYNELAVTLYQPMNDRSIVIRFRLFNDGLGFRYEFPQQKSLNYFVIKEEHSQFGMNGDHIAFWIPGDYDTQEYDYTISRLSEIRGLMKEAITPNSSQTPFSQTGVQTALMMKTDDGLYINLHEAALVDYSCMHLNLDDKNMVFESWLTPDAKGDKGYMQTPCNTPWRTIIVSDDARNILASRITLNLNEPCKIADAASWVKPVKYIGVWWDMITGKGSWAYTDELTSVKLGETDYSKTKPNGKHSANTANVKRYIDFAAAHGFDAVLVEGWNEGWEDWFGNSKDYVFDFVTPYPDFDVKEIHRYAARKGIKMMMHHETSASVRNYERHMDKAYQFMADNGYNSVKSGYVGNIIPRGEHHYGQWMNNHYLYAVKKAADYKIMVNAHEATRPTGICRTYPNLIGNESARGTEYESFGGNKVYHTTILPFTRLVGGPMDYTPGIFETHCNKMNPANNSQVRSTIARQLALYVTMYSPLQMAADIPENYERFMDAFQFIKDVALDWDETNYLEAEPGEYITIARKAKDTDDWYVGCTAGENGHTSKLVFDFLTPGKQYIATVYADAKDADWKENPQAYTIKKGILTNKSKLNLHAANGGGYAISIKEVKDKSEAKGLKRLHHHHHHEPEA

SEQ ID NO: 78 - protein, 1130 aa, Artificial Sequence
  homo-dimeric Megabody MbNb207SusBrandomlinkers_Aga2p_ACP protein seuqences
  misc_feature (105)..(105): Xaa can be any naturally occurring amino acid
  misc_feature (174)..(174): Xaa can be any naturally occurring amino acid
  misc_feature (286)..(286): Xaa can be any naturally occurring amino acid
MRFPSIFTAVVFAASSALAAPANTTAEDETAQIPAEAVIGYLGLEGDSDVAALPLSDSTNNGSLSTNTTIASIAAKEEGVQLDKREAEAQVQLVESGGGLVQASXMQQKLTSPDNNLVMTFQVDSKGAPTYELTYKNKVVIKPSTLGLELKKEDNTRTDFDWVDRRDLTKLDSXGGSLRLSCAASGRTFSTAAMGWFRQAPGKERDFVAGIYWTVGSTYYADSAKGRFTISRDNAKNTVYLQMDSLKPEDTAVYYCAARRRGFTLAPTRANEYDYWGQGTQVTVSXFEVKDTQTATFDETWQPVWGEEKEIRNHYNELAVTLYQPMNDRSIVIRFRLFNDGLGFRYEFPQQKSLNYFVIKEEHSQFGMNGDHIAFWIPGDYDTQEYDYTISRLSEIRGLMKEAITPNSSQTPFSQTGVQTALMMKTDDGLYINLHEAALVDYSCMHLNLDDKNMVFESWLTPDAKGDKGYMQTPCNTPWRTIIVSDDARNILASRITLNLNEPCKIADAASWVKPVKYIGVWWDMITGKGSWAYTDELTSVKLGETDYSKTKPNGKHSANTANVKRYIDFAAAHGFDAVLVEGWNEGWEDWFGNSKDYVFDFVTPYPDFDVKEIHRYAARKGIKMMMHHETSASVRNYERHMDKAYQFMADNGYNSVKSGYVGNIIPRGEHHYGQWMNNHYLYAVKKAADYKIMVNAHEATRPTGICRTYPNLIGNESARGTEYESFGGNKVYHTTILPFTRLVGGPMDYTPGIFETHCNKMNPANNSQVRSTIARQLALYVTMYSPLQMAADIPENYERFMDAFQFIKDVALDWDETNYLEAEPGEYITIARKAKDTDDWYVGCTAGENGHTSKLVFDFLTPGKQYIATVYADAKDADWKENPQAYTIKKGILTNKSKLNLHAANGGGYAISIKEVKDKSEAKGLKRLSLGGGSGGGGSGGGGSGGGGSGGGGSGGGGSGGGGSQELTTICEQIPSPTLESTPYSLSTTTILANGKAMQGVFEYYKSVTFVSNCGSHPSTTSKGSPINTQYVFKDNSSTSMSTIEERVKKIIGEQLGVKQEEVTNNASFVEDLGADSLDTVELVMALEEEFDTEIPDEEAEKITTVQAAIDYINGHQASEQKLISEEDL

SEQ ID NO: 79 - protein, 1131 aa, Artificial Sequence
  homo-dimeric Megabody MbNb207SusBrandomlinkers_Aga2p_ACP protein seuqences
  misc_feature (105)..(106): Xaa can be any naturally occurring amino acid
  misc_feature (175)..(175): Xaa can be any naturally occurring amino acid
  misc_feature (287)..(287): Xaa can be any naturally occurring amino acid
MRFPSIFTAVVFAASSALAAPANTTAEDETAQIPAEAVIGYLGLEGDSDVAALPLSDSTNNGSLSTNTTIASIAAKEEGVQLDKREAEAQVQLVESGGGLVQASXXMQQKLTSPDNNLVMTFQVDSKGAPTYELTYKNKVVIKPSTLGLELKKEDNTRTDFDWVDRRDLTKLDSXGGSLRLSCAASGRTFSTAAMGWFRQAPGKERDFVAGIYWTVGSTYYADSAKGRFTISRDNAKNTVYLQMDSLKPEDTAVYYCAARRRGFTLAPTRANEYDYWGQGTQVTVSXFEVKDTQTATFDETWQPVWGEEKEIRNHYNELAVTLYQPMNDRSIVIRFRLFNDGLGFRYEFPQQKSLNYFVIKEEHSQFGMNGDHIAFWIPGDYDTQEYDYTISRLSEIRGLMKEAITPNSSQTPFSQTGVQTALMMKTDDGLYINLHEAALVDYSCMHLNLDDKNMVFESWLTPDAKGDKGYMQTPCNTPWRTIIVSDDARNILASRITLNLNEPCKIADAASWVKPVKYIGVWWDMITGKGSWAYTDELTSVKLGETDYSKTKPNGKHSANTANVKRYIDFAAAHGFDAVLVEGWNEGWEDWFGNSKDYVFDFVTPYPDFDVKEIHRYAARKGIKMMMHHETSASVRNYERHMDKAYQFMADNGYNSVKSGYVGNIIPRGEHHYGQWMNNHYLYAVKKAADYKIMVNAHEATRPTGICRTYPNLIGNESARGTEYESFGGNKVYHTTILPFTRLVGGPMDYTPGIFETHCNKMNPANNSQVRSTIARQLALYVTMYSPLQMAADIPENYERFMDAFQFIKDVALDWDETNYLEAEPGEYITIARKAKDTDDWYVGCTAGENGHTSKLVFDFLTPGKQYIATVYADAKDADWKENPQAYTIKKGILTNKSKLNLHAANGGGYAISIKEVKDKSEAKGLKRLSLGGGSGGGGSGGGGSGGGGSGGGGSGGGGSGGGGSQELTTICEQIPSPTLESTPYSLSTTTILANGKAMQGVFEYYKSVTFVSNCGSHPSTTSKGSPINTQYVFKDNSSTSMSTIEERVKKIIGEQLGVKQEEVTNNASFVEDLGADSLDTVELVMALEEEFDTEIPDEEAEKITTVQAAIDYINGHQASEQKLISEEDL

SEQ ID NO: 80 - protein, 1131 aa, Artificial Sequence
  homo-dimeric Megabody MbNb207SusBrandomlinkers_Aga2p_ACP protein seuqences
  misc_feature (105)..(105): Xaa can be any naturally occurring amino acid
  misc_feature (174)..(175): Xaa can be any naturally occurring amino acid
  misc_feature (287)..(287): Xaa can be any naturally occurring amino acid
MRFPSIFTAVVFAASSALAAPANTTAEDETAQIPAEAVIGYLGLEGDSDVAALPLSDSTNNGSLSTNTTIASIAAKEEGVQLDKREAEAQVQLVESGGGLVQASXMQQKLTSPDNNLVMTFQVDSKGAPTYELTYKNKVVIKPSTLGLELKKEDNTRTDFDWVDRRDLTKLDSXXGGSLRLSCAASGRTFSTAAMGWFRQAPGKERDFVAGIYWTVGSTYYADSAKGRFTISRDNAKNTVYLQMDSLKPEDTAVYYCAARRRGFTLAPTRANEYDYWGQGTQVTVSXFEVKDTQTATFDETWQPVWGEEKEIRNHYNELAVTLYQPMNDRSIVIRFRLFNDGLGFRYEFPQQKSLNYFVIKEEHSQFGMNGDHIAFWIPGDYDTQEYDYTISRLSEIRGLMKEAITPNSSQTPFSQTGVQTALMMKTDDGLYINLHEAALVDYSCMHLNLDDKNMVFESWLTPDAKGDKGYMQTPCNTPWRTIIVSDDARNILASRITLNLNEPCKIADAASWVKPVKYIGVWWDMITGKGSWAYTDELTSVKLGETDYSKTKPNGKHSANTANVKRYIDFAAAHGFDAVLVEGWNEGWEDWFGNSKDYVFDFVTPYPDFDVKEIHRYAARKGIKMMMHHETSASVRNYERHMDKAYQFMADNGYNSVKSGYVGNIIPRGEHHYGQWMNNHYLYAVKKAADYKIMVNAHEATRPTGICRTYPNLIGNESARGTEYESFGGNKVYHTTILPFTRLVGGPMDYTPGIFETHCNKMNPANNSQVRSTIARQLALYVTMYSPLQMAADIPENYERFMDAFQFIKDVALDWDETNYLEAEPGEYITIARKAKDTDDWYVGCTAGENGHTSKLVFDFLTPGKQYIATVYADAKDADWKENPQAYTIKKGILTNKSKLNLHAANGGGYAISIKEVKDKSEAKGLKRLSLGGGSGGGGSGGGGSGGGGSGGGGSGGGGSGGGGSQELTTICEQIPSPTLESTPYSLSTTTILANGKAMQGVFEYYKSVTFVSNCGSHPSTTSKGSPINTQYVFKDNSSTSMSTIEERVKKIIGEQLGVKQEEVTNNASFVEDLGADSLDTVELVMALEEEFDTEIPDEEAEKITTVQAAIDYINGHQASEQKLISEEDL

SEQ ID NO: 81 - protein, 1131 aa, Artificial Sequence
  homo-dimeric Megabody MbNb207SusBrandomlinkers_Aga2p_ACP protein seuqences
  misc_feature (105)..(105): Xaa can be any naturally occurring amino acid
  misc_feature (174)..(174): Xaa can be any naturally occurring amino acid
  misc_feature (286)..(287): Xaa can be any naturally occurring amino acid
MRFPSIFTAVVFAASSALAAPANTTAEDETAQIPAEAVIGYLGLEGDSDVAALPLSDSTNNGSLSTNTTIASIAAKEEGVQLDKREAEAQVQLVESGGGLVQASXMQQKLTSPDNNLVMTFQVDSKGAPTYELTYKNKVVIKPSTLGLELKKEDNTRTDFDWVDRRDLTKLDSXGGSLRLSCAASGRTFSTAAMGWFRQAPGKERDFVAGIYWTVGSTYYADSAKGRFTISRDNAKNTVYLQMDSLKPEDTAVYYCAARRRGFTLAPTRANEYDYWGQGTQVTVSXXFEVKDTQTATFDETWQPVWGEEKEIRNHYNELAVTLYQPMNDRSIVIRFRLFNDGLGFRYEFPQQKSLNYFVIKEEHSQFGMNGDHIAFWIPGDYDTQEYDYTISRLSEIRGLMKEAITPNSSQTPFSQTGVQTALMMKTDDGLYINLHEAALVDYSCMHLNLDDKNMVFESWLTPDAKGDKGYMQTPCNTPWRTIIVSDDARNILASRITLNLNEPCKIADAASWVKPVKYIGVWWDMITGKGSWAYTDELTSVKLGETDYSKTKPNGKHSANTANVKRYIDFAAAHGFDAVLVEGWNEGWEDWFGNSKDYVFDFVTPYPDFDVKEIHRYAARKGIKMMMHHETSASVRNYERHMDKAYQFMADNGYNSVKSGYVGNIIPRGEHHYGQWMNNHYLYAVKKAADYKIMVNAHEATRPTGICRTYPNLIGNESARGTEYESFGGNKVYHTTILPFTRLVGGPMDYTPGIFETHCNKMNPANNSQVRSTIARQLALYVTMYSPLQMAADIPENYERFMDAFQFIKDVALDWDETNYLEAEPGEYITIARKAKDTDDWYVGCTAGENGHTSKLVFDFLTPGKQYIATVYADAKDADWKENPQAYTIKKGILTNKSKLNLHAANGGGYAISIKEVKDKSEAKGLKRLSLGGGSGGGGSGGGGSGGGGSGGGGSGGGGSGGGGSQELTTICEQIPSPTLESTPYSLSTTTILANGKAMQGVFEYYKSVTFVSNCGSHPSTTSKGSPINTQYVFKDNSSTSMSTIEERVKKIIGEQLGVKQEEVTNNASFVEDLGADSLDTVELVMALEEEFDTEIPDEEAEKITTVQAAIDYINGHQASEQKLISEEDL

SEQ ID NO: 82 - protein, 1132 aa, Artificial Sequence
  homo-dimeric Megabody MbNb207SusBrandomlinkers_Aga2p_ACP protein seuqences
  misc_feature (105)..(105): Xaa can be any naturally occurring amino acid
  misc_feature (174)..(175): Xaa can be any naturally occurring amino acid
  misc_feature (287)..(288): Xaa can be any naturally occurring amino acid
MRFPSIFTAVVFAASSALAAPANTTAEDETAQIPAEAVIGYLGLEGDSDVAALPLSDSTNNGSLSTNTTIASIAAKEEGVQLDKREAEAQVQLVESGGGLVQASXMQQKLTSPDNNLVMTFQVDSKGAPTYELTYKNKVVIKPSTLGLELKKEDNTRTDFDWVDRRDLTKLDSXXGGSLRLSCAASGRTFSTAAMGWFRQAPGKERDFVAGIYWTVGSTYYADSAKGRFTISRDNAKNTVYLQMDSLKPEDTAVYYCAARRRGFTLAPTRANEYDYWGQGTQVTVSXXFEVKDTQTATFDETWQPVWGEEKEIRNHYNELAVTLYQPMNDRSIVIRFRLFNDGLGFRYEFPQQKSLNYFVIKEEHSQFGMNGDHIAFWIPGDYDTQEYDYTISRLSEIRGLMKEAITPNSSQTPFSQTGVQTALMMKTDDGLYINLHEAALVDYSCMHLNLDDKNMVFESWLTPDAKGDKGYMQTPCNTPWRTIIVSDDARNILASRITLNLNEPCKIADAASWVKPVKYIGVWWDMITGKGSWAYTDELTSVKLGETDYSKTKPNGKHSANTANVKRYIDFAAAHGFDAVLVEGWNEGWEDWFGNSKDYVFDFVTPYPDFDVKEIHRYAARKGIKMMMHHETSASVRNYERHMDKAYQFMADNGYNSVKSGYVGNIIPRGEHHYGQWMNNHYLYAVKKAADYKIMVNAHEATRPTGICRTYPNLIGNESARGTEYESFGGNKVYHTTILPFTRLVGGPMDYTPGIFETHCNKMNPANNSQVRSTIARQLALYVTMYSPLQMAADIPENYERFMDAFQFIKDVALDWDETNYLEAEPGEYITIARKAKDTDDWYVGCTAGENGHTSKLVFDFLTPGKQYIATVYADAKDADWKENPQAYTIKKGILTNKSKLNLHAANGGGYAISIKEVKDKSEAKGLKRLSLGGGSGGGGSGGGGSGGGGSGGGGSGGGGSGGGGSQELTTICEQIPSPTLESTPYSLSTTTILANGKAMQGVFEYYKSVTFVSNCGSHPSTTSKGSPINTQYVFKDNSSTSMSTIEERVKKIIGEQLGVKQEEVTNNASFVEDLGADSLDTVELVMALEEEFDTEIPDEEAEKITTVQAAIDYINGHQASEQKLISEEDL

SEQ ID NO: 83 - protein, 1132 aa, Artificial Sequence
  homo-dimeric Megabody MbNb207SusBrandomlinkers_Aga2p_ACP protein seuqences
  misc_feature (105)..(106): Xaa can be any naturally occurring amino acid
  misc_feature (175)..(175): Xaa can be any naturally occurring amino acid
  misc_feature (287)..(288): Xaa can be any naturally occurring amino acid
MRFPSIFTAVVFAASSALAAPANTTAEDETAQIPAEAVIGYLGLEGDSDVAALPLSDSTNNGSLSTNTTIASIAAKEEGVQLDKREAEAQVQLVESGGGLVQASXXMQQKLTSPDNNLVMTFQVDSKGAPTYELTYKNKVVIKPSTLGLELKKEDNTRTDFDWVDRRDLTKLDSXGGSLRLSCAASGRTFSTAAMGWFRQAPGKERDFVAGIYWTVGSTYYADSAKGRFTISRDNAKNTVYLQMDSLKPEDTAVYYCAARRRGFTLAPTRANEYDYWGQGTQVTVSXXFEVKDTQTATFDETWQPVWGEEKEIRNHYNELAVTLYQPMNDRSIVIRFRLFNDGLGFRYEFPQQKSLNYFVIKEEHSQFGMNGDHIAFWIPGDYDTQEYDYTISRLSEIRGLMKEAITPNSSQTPFSQTGVQTALMMKTDDGLYINLHEAALVDYSCMHLNLDDKNMVFESWLTPDAKGDKGYMQTPCNTPWRTIIVSDDARNILASRITLNLNEPCKIADAASWVKPVKYIGVWWDMITGKGSWAYTDELTSVKLGETDYSKTKPNGKHSANTANVKRYIDFAAAHGFDAVLVEGWNEGWEDWFGNSKDYVFDFVTPYPDFDVKEIHRYAARKGIKMMMHHETSASVRNYERHMDKAYQFMADNGYNSVKSGYVGNIIPRGEHHYGQWMNNHYLYAVKKAADYKIMVNAHEATRPTGICRTYPNLIGNESARGTEYESFGGNKVYHTTILPFTRLVGGPMDYTPGIFETHCNKMNPANNSQVRSTIARQLALYVTMYSPLQMAADIPENYERFMDAFQFIKDVALDWDETNYLEAEPGEYITIARKAKDTDDWYVGCTAGENGHTSKLVFDFLTPGKQYIATVYADAKDADWKENPQAYTIKKGILTNKSKLNLHAANGGGYAISIKEVKDKSEAKGLKRLSLGGGSGGGGSGGGGSGGGGSGGGGSGGGGSGGGGSQELTTICEQIPSPTLESTPYSLSTTTILANGKAMQGVFEYYKSVTFVSNCGSHPSTTSKGSPINTQYVFKDNSSTSMSTIEERVKKIIGEQLGVKQEEVTNNASFVEDLGADSLDTVELVMALEEEFDTEIPDEEAEKITTVQAAIDYINGHQASEQKLISEEDL

SEQ ID NO: 84 - protein, 1132 aa, Artificial Sequence
  homo-dimeric Megabody MbNb207SusBrandomlinkers_Aga2p_ACP protein seuqences
  misc_feature (105)..(106): Xaa can be any naturally occurring amino acid
  misc_feature (175)..(176): Xaa can be any naturally occurring amino acid
  misc_feature (288)..(288): Xaa can be any naturally occurring amino acid
MRFPSIFTAVVFAASSALAAPANTTAEDETAQIPAEAVIGYLGLEGDSDVAALPLSDSTNNGSLSTNTTIASIAAKEEGVQLDKREAEAQVQLVESGGGLVQASXXMQQKLTSPDNNLVMTFQVDSKGAPTYELTYKNKVVIKPSTLGLELKKEDNTRTDFDWVDRRDLTKLDSXXGGSLRLSCAASGRTFSTAAMGWFRQAPGKERDFVAGIYWTVGSTYYADSAKGRFTISRDNAKNTVYLQMDSLKPEDTAVYYCAARRRGFTLAPTRANEYDYWGQGTQVTVSXFEVKDTQTATFDETWQPVWGEEKEIRNHYNELAVTLYQPMNDRSIVIRFRLFNDGLGFRYEFPQQKSLNYFVIKEEHSQFGMNGDHIAFWIPGDYDTQEYDYTISRLSEIRGLMKEAITPNSSQTPFSQTGVQTALMMKTDDGLYINLHEAALVDYSCMHLNLDDKNMVFESWLTPDAKGDKGYMQTPCNTPWRTIIVSDDARNILASRITLNLNEPCKIADAASWVKPVKYIGVWWDMITGKGSWAYTDELTSVKLGETDYSKTKPNGKHSANTANVKRYIDFAAAHGFDAVLVEGWNEGWEDWFGNSKDYVFDFVTPYPDFDVKEIHRYAARKGIKMMMHHETSASVRNYERHMDKAYQFMADNGYNSVKSGYVGNIIPRGEHHYGQWMNNHYLYAVKKAADYKIMVNAHEATRPTGICRTYPNLIGNESARGTEYESFGGNKVYHTTILPFTRLVGGPMDYTPGIFETHCNKMNPANNSQVRSTIARQLALYVTMYSPLQMAADIPENYERFMDAFQFIKDVALDWDETNYLEAEPGEYITIARKAKDTDDWYVGCTAGENGHTSKLVFDFLTPGKQYIATVYADAKDADWKENPQAYTIKKGILTNKSKLNLHAANGGGYAISIKEVKDKSEAKGLKRLSLGGGSGGGGSGGGGSGGGGSGGGGSGGGGSGGGGSQELTTICEQIPSPTLESTPYSLSTTTILANGKAMQGVFEYYKSVTFVSNCGSHPSTTSKGSPINTQYVFKDNSSTSMSTIEERVKKIIGEQLGVKQEEVTNNASFVEDLGADSLDTVELVMALEEEFDTEIPDEEAEKITTVQAAIDYINGHQASEQKLISEEDL

SEQ ID NO: 85 - protein, 1133 aa, Artificial Sequence
  homo-dimeric Megabody MbNb207SusBrandomlinkers_Aga2p_ACP protein seuqences
  misc_feature (105)..(106): Xaa can be any naturally occurring amino acid
  misc_feature (175)..(176): Xaa can be any naturally occurring amino acid
  misc_feature (288)..(289): Xaa can be any naturally occurring amino acid
MRFPSIFTAVVFAASSALAAPANTTAEDETAQIPAEAVIGYLGLEGDSDVAALPLSDSTNNGSLSTNTTIASIAAKEEGVQLDKREAEAQVQLVESGGGLVQASXXMQQKLTSPDNNLVMTFQVDSKGAPTYELTYKNKVVIKPSTLGLELKKEDNTRTDFDWVDRRDLTKLDSXXGGSLRLSCAASGRTFSTAAMGWFRQAPGKERDFVAGIYWTVGSTYYADSAKGRFTISRDNAKNTVYLQMDSLKPEDTAVYYCAARRRGFTLAPTRANEYDYWGQGTQVTVSXXFEVKDTQTATFDETWQPVWGEEKEIRNHYNELAVTLYQPMNDRSIVIRFRLFNDGLGFRYEFPQQKSLNYFVIKEEHSQFGMNGDHIAFWIPGDYDTQEYDYTISRLSEIRGLMKEAITPNSSQTPFSQTGVQTALMMKTDDGLYINLHEAALVDYSCMHLNLDDKNMVFESWLTPDAKGDKGYMQTPCNTPWRTIIVSDDARNILASRITLNLNEPCKIADAASWVKPVKYIGVWWDMITGKGSWAYTDELTSVKLGETDYSKTKPNGKHSANTANVKRYIDFAAAHGFDAVLVEGWNEGWEDWFGNSKDYVFDFVTPYPDFDVKEIHRYAARKGIKMMMHHETSASVRNYERHMDKAYQFMADNGYNSVKSGYVGNIIPRGEHHYGQWMNNHYLYAVKKAADYKIMVNAHEATRPTGICRTYPNLIGNESARGTEYESFGGNKVYHTTILPFTRLVGGPMDYTPGIFETHCNKMNPANNSQVRSTIARQLALYVTMYSPLQMAADIPENYERFMDAFQFIKDVALDWDETNYLEAEPGEYITIARKAKDTDDWYVGCTAGENGHTSKLVFDFLTPGKQYIATVYADAKDADWKENPQAYTIKKGILTNKSKLNLHAANGGGYAISIKEVKDKSEAKGLKRLSLGGGSGGGGSGGGGSGGGGSGGGGSGGGGSGGGGSQELTTICEQIPSPTLESTPYSLSTTTILANGKAMQGVFEYYKSVTFVSNCGSHPSTTSKGSPINTQYVFKDNSSTSMSTIEERVKKIIGEQLGVKQEEVTNNASFVEDLGADSLDTVELVMALEEEFDTEIPDEEAEKITTVQAAIDYINGHQASEQKLISEEDL

SEQ ID NO: 86 - protein, 77 aa, Escherichia coli
STIEERVKKIIGEQLGVKQEEVTNNASFVEDLGADSLDTVELVMALEEEFDTEIPDEEAEKITTVQAAIDYINGHQA

SEQ ID NO: 87 - protein, 208 aa, Artificial Sequence
  Nanotool MbNb207ACPrandomlinkers
  misc_feature (12)..(12): Xaa can be any naturally occurring amino acid
  misc_feature (88)..(88): Xaa can be any naturally occurring amino acid
QVQLVESGGGLXTIEERVKKIIGEQLGVKQEEVTNNASFVEDLGADSLDTVELVMALEEEFDTEIPDEEAEKITTVQAAIDYINGHQXSLRLSCAASGRTFSTAAMGWFRQAPGKERDFVAGIYWTVGSTYYADSAKGRFTISRDNAKNTVYLQMDSLKPEDTAVYYCAARRRGFTLAPTRANEYDYWGQGTQVTVSSHHHHHHEPEA

SEQ ID NO: 88 - protein, 209 aa, Artificial Sequence
  Nanotool MbNb207ACPrandomlinkers
  misc_feature (12)..(13): Xaa can be any naturally occurring amino acid
  misc_feature (89)..(89): Xaa can be any naturally occurring amino acid
QVQLVESGGGLXXTIEERVKKIIGEQLGVKQEEVTNNASFVEDLGADSLDTVELVMALEEEFDTEIPDEEAEKITTVQAAIDYINGHQXSLRLSCAASGRTFSTAAMGWFRQAPGKERDFVAGIYWTVGSTYYADSAKGRFTISRDNAKNTVYLQMDSLKPEDTAVYYCAARRRGFTLAPTRANEYDYWGQGTQVTVSSHHHHHHEPEA

SEQ ID NO: 89 - protein, 209 aa, Artificial Sequence
  Nanotool MbNb207ACPrandomlinkers
  misc_feature (12)..(12): Xaa can be any naturally occurring amino acid
  misc_feature (88)..(89): Xaa can be any naturally occurring amino acid
QVQLVESGGGLXTIEERVKKIIGEQLGVKQEEVTNNASFVEDLGADSLDTVELVMALEEEFDTEIPDEEAEKITTVQAAIDYINGHQXXSLRLSCAASGRTFSTAAMGWFRQAPGKERDFVAGIYWTVGSTYYADSAKGRFTISRDNAKNTVYLQMDSLKPEDTAVYYCAARRRGFTLAPTRANEYDYWGQGTQVTVSSHHHHHHEPEA

SEQ ID NO: 90 - protein, 210 aa, Artificial Sequence
  Nanotool MbNb207ACPrandomlinkers
  misc_feature (12)..(13): Xaa can be any naturally occurring amino acid
  misc_feature (89)..(90): Xaa can be any naturally occurring amino acid
QVQLVESGGGLXXTIEERVKKIIGEQLGVKQEEVTNNASFVEDLGADSLDTVELVMALEEEFDTEIPDEEAEKITTVQAAIDYINGHQXXSLRLSCAASGRTFSTAAMGWFRQAPGKERDFVAGIYWTVGSTYYADSAKGRFTISRDNAKNTVYLQMDSLKPEDTAVYYCAARRRGFTLAPTRANEYDYWGQGTQVTVSSHHHHHHEPEA

SEQ ID NO: 91 - protein, 408 aa, Artificial Sequence
  Nanotool MbNb207ACPrandomlinkers _Aga2p protein sequences
  misc_feature (101)..(101): Xaa can be any naturally occurring amino acid
  misc_feature (177)..(177): Xaa can be any naturally occurring amino acid
MRFPSIFTAVVFAASSALAAPANTTAEDETAQIPAEAVIGYLGLEGDSDVAALPLSDSTNNGSLSTNTTIASIAAKEEGVQLDKREAEAQVQLVESGGGLXTIEERVKKIIGEQLGVKQEEVTNNASFVEDLGADSLDTVELVMALEEEFDTEIPDEEAEKITTVQAAIDYINGHQXSLRLSCAASGRTFSTAAMGWFRQAPGKERDFVAGIYWTVGSTYYADSAKGRFTISRDNAKNTVYLQMDSLKPEDTAVYYCAARRRGFTLAPTRANEYDYWGQGTQVTVSSLGGGSGGGGSGGGGSGGGGSGGGGSGGGGSGGGGSQELTTICEQIPSPTLESTPYSLSTTTILANGKAMQGVFEYYKSVTFVSNCGSHPSTTSKGSPINTQYVFKDNSSTSEQKLISEEDL

SEQ ID NO: 92 - protein, 409 aa, Artificial Sequence
  Nanotool MbNb207ACPrandomlinkers _Aga2p protein sequences
  misc_feature (101)..(102): Xaa can be any naturally occurring amino acid
  misc_feature (178)..(178): Xaa can be any naturally occurring amino acid
MRFPSIFTAVVFAASSALAAPANTTAEDETAQIPAEAVIGYLGLEGDSDVAALPLSDSTNNGSLSTNTTIASIAAKEEGVQLDKREAEAQVQLVESGGGLXXTIEERVKKIIGEQLGVKQEEVTNNASFVEDLGADSLDTVELVMALEEEFDTEIPDEEAEKITTVQAAIDYINGHQXSLRLSCAASGRTFSTAAMGWFRQAPGKERDFVAGIYWTVGSTYYADSAKGRFTISRDNAKNTVYLQMDSLKPEDTAVYYCAARRRGFTLAPTRANEYDYWGQGTQVTVSSLGGGSGGGGSGGGGSGGGGSGGGGSGGGGSGGGGSQELTTICEQIPSPTLESTPYSLSTTTILANGKAMQGVFEYYKSVTFVSNCGSHPSTTSKGSPINTQYVFKDNSSTSEQKLISEEDL

SEQ ID NO: 93 - protein, 409 aa, Artificial Sequence
  Nanotool MbNb207ACPrandomlinkers _Aga2p protein sequences
  misc_feature (101)..(101): Xaa can be any naturally occurring amino acid
  misc_feature (177)..(178): Xaa can be any naturally occurring amino acid
MRFPSIFTAVVFAASSALAAPANTTAEDETAQIPAEAVIGYLGLEGDSDVAALPLSDSTNNGSLSTNTTIASIAAKEEGVQLDKREAEAQVQLVESGGGLXTIEERVKKIIGEQLGVKQEEVTNNASFVEDLGADSLDTVELVMALEEEFDTEIPDEEAEKITTVQAAIDYINGHQXXSLRLSCAASGRTFSTAAMGWFRQAPGKERDFVAGIYWTVGSTYYADSAKGRFTISRDNAKNTVYLQMDSLKPEDTAVYYCAARRRGFTLAPTRANEYDYWGQGTQVTVSSLGGGSGGGGSGGGGSGGGGSGGGGSGGGGSGGGGSQELTTICEQIPSPTLESTPYSLSTTTILANGKAMQGVFEYYKSVTFVSNCGSHPSTTSKGSPINTQYVFKDNSSTSEQKLISEEDL

SEQ ID NO: 94 - protein, 410 aa, Artificial Sequence
  Nanotool MbNb207ACPrandomlinkers _Aga2p protein sequences
  misc_feature (101)..(102): Xaa can be any naturally occurring amino acid
  misc_feature (178)..(179): Xaa can be any naturally occurring amino acid
MRFPSIFTAVVFAASSALAAPANTTAEDETAQIPAEAVIGYLGLEGDSDVAALPLSDSTNNGSLSTNTTIASIAAKEEGVQLDKREAEAQVQLVESGGGLXXTIEERVKKIIGEQLGVKQEEVTNNASFVEDLGADSLDTVELVMALEEEFDTEIPDEEAEKITTVQAAIDYINGHQXXSLRLSCAASGRTFSTAAMGWFRQAPGKERDFVAGIYWTVGSTYYADSAKGRFTISRDNAKNTVYLQMDSLKPEDTAVYYCAARRRGFTLAPTRANEYDYWGQGTQVTVSSLGGGSGGGGSGGGGSGGGGSGGGGSGGGGSGGGGSQELTTICEQIPSPTLESTPYSLSTTTILANGKAMQGVFEYYKSVTFVSNCGSHPSTTSKGSPINTQYVFKDNSSTSEQKLISEEDL

SEQ ID NO: 95 - protein, 532 aa, Artificial Sequence
  MbNb207cHopQMP1251_A7
QVQLVESGGGLVQTKTTTSVIDTTNDAQNLLTQAQTIVNTLKDYCPILIAKSSSSNGGTNNANTPSWQTAGGGKNSCATFGAEFSAASDMINNAQKIVQETQQLSANQPKNITQPHNLNLNSPSSLTALAQKMLKNAQSQAEILKLANQVESDFNKLSSGHLKDYIGKCDASAISSANMTMQNQKNNWGNGCAGVEETQSLLKTSAADFNNQTPQINQAQNLANTLIQELGNNPFRASGGGSGGGGSGKLSDTYEQLSRLLTNDNGTNSKTSAQAINQAVNNLNERAKTLAGGTTNSPAYQATLLALRSVLGLWNSMGYAVICGGYTKSPGENNQKDFHYTDENGNGTTINCGGSTNSNGTHSYNGTNTLKADKNVSLSIEQYEKIHEAYQILSKALKQAGLAPLNSKGEKLEAHVTTSKYGSLRLSCAASGRTFSVSNMGWFRQAPGKERVFVAAIGWTTGSTYYADSVKGRFTISRDNTKNTVYLQMNSLKPEDTAVYRCAARRRGYSRVPMTPDEYEYWGQGTQVTVSS

SEQ ID NO: 96 - protein, 532 aa, Artificial Sequence
  MbNb207cHopQMP1252_D10
QVQLVESGGGLVQTKTTTSVIDTTNDAQNLLTQAQTIVNTLKDYCPILIAKSSSSNGGTNNANTPSWQTAGGGKNSCATFGAEFSAASDMINNAQKIVQETQQLSANQPKNITQPHNLNLNSPSSLTALAQKMLKNAQSQAEILKLANQVESDFNKLSSGHLKDYIGKCDASAISSANMTMQNQKNNWGNGCAGVEETQSLLKTSAADFNNQTPQINQAQNLANTLIQELGNNPFRASGGGSGGGGSGKLSDTYEQLSRLLTNDNGTNSKTSAQAINQAVNNLNERAKTLAGGTTNSPAYQATLLALRSVLGLWNSMGYAVICGGYTKSPGENNQKDFHYTDENGNGTTINCGGSTNSNGTHSYNGTNTLKADKNVSLSIEQYEKIHEAYQILSKALKQAGLAPLNSKGEKLEAHVTTSKYGSLRLSCAASGRTFSLSMMGWFRQAPGKEREFVAGISWSRGSTYYADSVKGRFTISRDNTKNTVILQMNSLKPEDTAVYVCAARRRGYISIPTTPDEFDYWGQGTQVTVSS

SEQ ID NO: 97 - protein, 532 aa, Artificial Sequence
  MbNb207cHopQMP1251_D10
QVQLVESGGGLVQTKTTTSVIDTTNDAQNLLTQAQTIVNTLKDYCPILIAKSSSSNGGTNNANTPSWQTAGGGKNSCATFGAEFSAASDMINNAQKIVQETQQLSANQPKNITQPHNLNLNSPSSLTALAQKMLKNAQSQAEILKLANQVESDFNKLSSGHLKDYIGKCDASAISSANMTMQNQKNNWGNGCAGVEETQSLLKTSAADFNNQTPQINQAQNLANTLIQELGNNPFRASGGGSGGGGSGKLSDTYEQLSRLLTNDNGTNSKTSAQAINQAVNNLNERAKTLAGGTTNSPAYQATLLALRSVLGLWNSMGYAVICGGYTKSPGENNQKDFHYTDENGNGTTINCGGSTNSNGTHSYNGTNTLKADKNVSLSIEQYEKIHEAYQILSKALKQAGLAPLNSKGEKLEAHVTTSKYGSLRLSCAASGRTFSTAAMGWFRQAPGKERDFVAGIYWTVGSTYYADSAKGRFTISRDNAKNTVYLQMDSLKPEDTAVYYCAARRRGFTLAPTRANEYDYWGQGTQVTVSS

SEQ ID NO: 98 - protein, 532 aa, Artificial Sequence
  MbNb207cHopQMP1251_A10
QVQLVESGGGLVQTKTTTSVIDTTNDAQNLLTQAQTIVNTLKDYCPILIAKSSSSNGGTNNANTPSWQTAGGGKNSCATFGAEFSAASDMINNAQKIVQETQQLSANQPKNITQPHNLNLNSPSSLTALAQKMLKNAQSQAEILKLANQVESDFNKLSSGHLKDYIGKCDASAISSANMTMQNQKNNWGNGCAGVEETQSLLKTSAADFNNQTPQINQAQNLANTLIQELGNNPFRASGGGSGGGGSGKLSDTYEQLSRLLTNDNGTNSKTSAQAINQAVNNLNERAKTLAGGTTNSPAYQATLLALRSVLGLWNSMGYAVICGGYTKSPGENNQKDFHYTDENGNGTTINCGGSTNSNGTHSYNGTNTLKADKNVSLSIEQYEKIHEAYQILSKALKQAGLAPLNSKGEKLEAHVTTSKYGSLRLSCAASGRTFSISLMGWFRQAPGKEREFVAGIGWSTGNTYYSDSVKGRFTISRDNAKNTVYLQMNSLKPEDTAIYYCAARRRGWGPIPTMENEYDYWGQGTQVTVSS

SEQ ID NO: 99 - protein, 532 aa, Artificial Sequence
  MbNb207cHopQMP1251_D4
QVQLVESGGGLVQTKTTTSVIDTTNDAQNLLTQAQTIVNTLKDYCPILIAKSSSSNGGTNNANTPSWQTAGGGKNSCATFGAEFSAASDMINNAQKIVQETQQLSANQPKNITQPHNLNLNSPSSLTALAQKMLKNAQSQAEILKLANQVESDFNKLSSGHLKDYIGKCDASAISSANMTMQNQKNNWGNGCAGVEETQSLLKTSAADFNNQTPQINQAQNLANTLIQELGNNPFRASGGGSGGGGSGKLSDTYEQLSRLLTNDNGTNSKTSAQAINQAVNNLNERAKTLAGGTTNSPAYQATLLALRSVLGLWNSMGYAVICGGYTKSPGENNQKDFHYTDENGNGTTINCGGSTNSNGTHSYNGTNTLKADKNVSLSIEQYEKIHEAYQILSKALKQAGLAPLNSKGEKLEAHVTTSKYGSLRLSCAASGRTFSMSAMGWFRQAPGKERDFTALITWSVGSPSYADSVKGRFTISRDSAKNTMYLQMNSLKPEDTAVYYCAARRAGYVRLPTREDEYDYWGQGTQVTVSS

SEQ ID NO: 100 - protein, 532 aa, Artificial Sequence
  MbNb207cHopQMP1252_C10
QVQLVESGGGLVQTKTTTSVIDTTNDAQNLLTQAQTIVNTLKDYCPILIAKSSSSNGGTNNANTPSWQTAGGGKNSCATFGAEFSAASDMINNAQKIVQETQQLSANQPKNITQPHNLNLNSPSSLTALAQKMLKNAQSQAEILKLANQVESDFNKLSSGHLKDYIGKCDASAISSANMTMQNQKNNWGNGCAGVEETQSLLKTSAADFNNQTPQINQAQNLANTLIQELGNNPFRASGGGSGGGGSGKLSDTYEQLSRLLTNDNGTNSKTSAQAINQAVNNLNERAKTLAGGTTNSPAYQATLLALRSVLGLWNSMGYAVICGGYTKSPGENNQKDFHYTDENGNGTTINCGGSTNSNGTHSYNGTNTLKADKNVSLSIEQYEKIHEAYQILSKALKQAGLAPLNSKGEKLEAHVTTSKYGSLRLSCAASGRTFSMSAVGWFRQAPGKEREFIALISWTVGRPYYADSVKGRFTISRDNAKNTMYLQMNSLKPEDTAVYYCAARRAGYSRVPTREYDYDYWGQGTQVTVSS

SEQ ID NO: 101 - protein, 532 aa, Artificial Sequence
  MbNb207cHopQMP1251_H6
QVQLVESGGGLVQTKTTTSVIDTTNDAQNLLTQAQTIVNTLKDYCPILIAKSSSSNGGTNNANTPSWQTAGGGKNSCATFGAEFSAASDMINNAQKIVQETQQLSANQPKNITQPHNLNLNSPSSLTALAQKMLKNAQSQAEILKLANQVESDFNKLSSGHLKDYIGKCDASAISSANMTMQNQKNNWGNGCAGVEETQSLLKTSAADFNNQTPQINQAQNLANTLIQELGNNPFRASGGGSGGGGSGKLSDTYEQLSRLLTNDNGTNSKTSAQAINQAVNNLNERAKTLAGGTTNSPAYQATLLALRSVLGLWNSMGYAVICGGYTKSPGENNQKDFHYTDENGNGTTINCGGSTNSNGTHSYNGTNTLKADKNVSLSIEQYEKIHEAYQILSKALKQAGLAPLNSKGEKLEAHVTTSKYGSLRLSCAASGGTFSISAMGWFRQAPGKEREFIALISWNVGRPYYEDSVKGRFTISRDNAKNTMFLQIHSLKPEDTAVYYCAGRRAGYFGMPTREYEYEYWGQGTQVTVSS

SEQ ID NO: 102 - protein, 531 aa, Artificial Sequence
  MbNb207cHopQMP1251_A5
QVQLVESGGGLVQTKTTTSVIDTTNDAQNLLTQAQTIVNTLKDYCPILIAKSSSSNGGTNNANTPSWQTAGGGKNSCATFGAEFSAASDMINNAQKIVQETQQLSANQPKNITQPHNLNLNSPSSLTALAQKMLKNAQSQAEILKLANQVESDFNKLSSGHLKDYIGKCDASAISSANMTMQNQKNNWGNGCAGVEETQSLLKTSAADFNNQTPQINQAQNLANTLIQELGNNPFRASGGGSGGGGSGKLSDTYEQLSRLLTNDNGTNSKTSAQAINQAVNNLNERAKTLAGGTTNSPAYQATLLALRSVLGLWNSMGYAVICGGYTKSPGENNQKDFHYTDENGNGTTINCGGSTNSNGTHSYNGTNTLKADKNVSLSIEQYEKIHEAYQILSKALKQAGLAPLNSKGEKLEAHVTTSKYGSLRLSCAASGRTSSNNHMAWFRQGPRKEREFVAAISWSRDFTKYADSVEGRFIISRDNAKNTVYLQMNSLSPEDTAVYYCAAAPWGTNWRVKESEYDYWGQGTQVTVSS

SEQ ID NO: 103 - protein, 531 aa, Artificial Sequence
  MbNb207cHopQMP1263_C9
QVQLVESGGGLVQTKTTTSVIDTTNDAQNLLTQAQTIVNTLKDYCPILIAKSSSSNGGTNNANTPSWQTAGGGKNSCATFGAEFSAASDMINNAQKIVQETQQLSANQPKNITQPHNLNLNSPSSLTALAQKMLKNAQSQAEILKLANQVESDFNKLSSGHLKDYIGKCDASAISSANMTMQNQKNNWGNGCAGVEETQSLLKTSAADFNNQTPQINQAQNLANTLIQELGNNPFRASGGGSGGGGSGKLSDTYEQLSRLLTNDNGTNSKTSAQAINQAVNNLNERAKTLAGGTTNSPAYQATLLALRSVLGLWNSMGYAVICGGYTKSPGENNQKDFHYTDENGNGTTINCGGSTNSNGTHSYNGTNTLKADKNVSLSIEQYEKIHEAYQILSKALKQAGLAPLNSKGEKLEAHVTTSKYGSLRLSCAASGRTFSSDAVGWFRQAPGKEREFVAYISWSNAITYYADSVEGRFTISRDNAENTVYLQMNSLKAEDTAIYYCAGGLNSYGSTWAPQSYAVWGQGTQVTVSS

SEQ ID NO: 104 - protein, 539 aa, Artificial Sequence
  MbNb207cHopQ_betaturnCC'_randomlinkers protein sequences
  misc_feature (40)..(40): Xaa can be any naturally occurring amino acid
  misc_feature (448)..(448): Xaa can be any naturally occurring amino acid
QVQLVESGGGLVQAGGSLRLSCAASGRTFSTAAMGWFRQXKTTTSVIDTTNDAQNLLTQAQTIVNTLKDYCPILIAKSSSSNGGTNNANTPSWQTAGGGKNSCATFGAEFSAASDMINNAQKIVQETQQLSANQPKNITQPHNLNLNSPSSLTALAQKMLKNAQSQAEILKLANQVESDFNKLSSGHLKDYIGKCDASAISSANMTMQNQKNNWGNGCAGVEETQSLLKTSAADFNNQTPQINQAQNLANTLIQELGNNPFRASGGGSGGGGSGKLSDTYEQLSRLLTNDNGTNSKTSAQAINQAVNNLNERAKTLAGGTTNSPAYQATLLALRSVLGLWNSMGYAVICGGYTKSPGENNQKDFHYTDENGNGTTINCGGSTNSNGTHSYNGTNTLKADKNVSLSIEQYEKIHEAYQILSKALKQAGLAPLNSKGEKLEAHVTTSKYXDFVAGIYWTVGSTYYADSAKGRFTISRDNAKNTVYLQMDSLKPEDTAVYYCAARRRGFTLAPTRANEYDYWGQGTQVTVSSHHHHHHEPEA

SEQ ID NO: 105 - protein, 540 aa, Artificial Sequence
  MbNb207cHopQ_betaturnCC'_randomlinkers protein sequences
  misc_feature (40)..(41): Xaa can be any naturally occurring amino acid
  misc_feature (449)..(449): Xaa can be any naturally occurring amino acid
QVQLVESGGGLVQAGGSLRLSCAASGRTFSTAAMGWFRQXXKTTTSVIDTTNDAQNLLTQAQTIVNTLKDYCPILIAKSSSSNGGTNNANTPSWQTAGGGKNSCATFGAEFSAASDMINNAQKIVQETQQLSANQPKNITQPHNLNLNSPSSLTALAQKMLKNAQSQAEILKLANQVESDFNKLSSGHLKDYIGKCDASAISSANMTMQNQKNNWGNGCAGVEETQSLLKTSAADFNNQTPQINQAQNLANTLIQELGNNPFRASGGGSGGGGSGKLSDTYEQLSRLLTNDNGTNSKTSAQAINQAVNNLNERAKTLAGGTTNSPAYQATLLALRSVLGLWNSMGYAVICGGYTKSPGENNQKDFHYTDENGNGTTINCGGSTNSNGTHSYNGTNTLKADKNVSLSIEQYEKIHEAYQILSKALKQAGLAPLNSKGEKLEAHVTTSKYXDFVAGIYWTVGSTYYADSAKGRFTISRDNAKNTVYLQMDSLKPEDTAVYYCAARRRGFTLAPTRANEYDYWGQGTQVTVSSHHHHHHEPEA

SEQ ID NO: 106 - protein, 540 aa, Artificial Sequence
  MbNb207cHopQ_betaturnCC'_randomlinkers protein sequences
  misc_feature (40)..(40): Xaa can be any naturally occurring amino acid
  misc_feature (448)..(449): Xaa can be any naturally occurring amino acid
QVQLVESGGGLVQAGGSLRLSCAASGRTFSTAAMGWFRQXKTTTSVIDTTNDAQNLLTQAQTIVNTLKDYCPILIAKSSSSNGGTNNANTPSWQTAGGGKNSCATFGAEFSAASDMINNAQKIVQETQQLSANQPKNITQPHNLNLNSPSSLTALAQKMLKNAQSQAEILKLANQVESDFNKLSSGHLKDYIGKCDASAISSANMTMQNQKNNWGNGCAGVEETQSLLKTSAADFNNQTPQINQAQNLANTLIQELGNNPFRASGGGSGGGGSGKLSDTYEQLSRLLTNDNGTNSKTSAQAINQAVNNLNERAKTLAGGTTNSPAYQATLLALRSVLGLWNSMGYAVICGGYTKSPGENNQKDFHYTDENGNGTTINCGGSTNSNGTHSYNGTNTLKADKNVSLSIEQYEKIHEAYQILSKALKQAGLAPLNSKGEKLEAHVTTSKYXXDFVAGIYWTVGSTYYADSAKGRFTISRDNAKNTVYLQMDSLKPEDTAVYYCAARRRGFTLAPTRANEYDYWGQGTQVTVSSHHHHHHEPEA

SEQ ID NO: 107 - protein, 541 aa, Artificial Sequence
  MbNb207cHopQ_betaturnCC'_randomlinkers protein sequences
  misc_feature (40)..(41): Xaa can be any naturally occurring amino acid
  misc_feature (449)..(450): Xaa can be any naturally occurring amino acid
QVQLVESGGGLVQAGGSLRLSCAASGRTFSTAAMGWFRQXXKTTTSVIDTTNDAQNLLTQAQTIVNTLKDYCPILIAKSSSSNGGTNNANTPSWQTAGGGKNSCATFGAEFSAASDMINNAQKIVQETQQLSANQPKNITQPHNLNLNSPSSLTALAQKMLKNAQSQAEILKLANQVESDFNKLSSGHLKDYIGKCDASAISSANMTMQNQKNNWGNGCAGVEETQSLLKTSAADFNNQTPQINQAQNLANTLIQELGNNPFRASGGGSGGGGSGKLSDTYEQLSRLLTNDNGTNSKTSAQAINQAVNNLNERAKTLAGGTTNSPAYQATLLALRSVLGLWNSMGYAVICGGYTKSPGENNQKDFHYTDENGNGTTINCGGSTNSNGTHSYNGTNTLKADKNVSLSIEQYEKIHEAYQILSKALKQAGLAPLNSKGEKLEAHVTTSKYXXDFVAGIYWTVGSTYYADSAKGRFTISRDNAKNTVYLQMDSLKPEDTAVYYCAARRRGFTLAPTRANEYDYWGQGTQVTVSSHHHHHHEPEA

SEQ ID NO: 108 - protein, 818 aa, Artificial Sequence
  MbNb207cHopQ_betaturnCC'_randomlinkers_Aga2p_ACP protein sequences
  misc_feature (129)..(129): Xaa can be any naturally occurring amino acid
  misc_feature (537)..(537): Xaa can be any naturally occurring amino acid
MRFPSIFTAVVFAASSALAAPANTTAEDETAQIPAEAVIGYLGLEGDSDVAALPLSDSTNNGSLSTNTTIASIAAKEEGVQLDKREAEAQVQLVESGGGLVQAGGSLRLSCAASGRTFSTAAMGWFRQXKTTTSVIDTTNDAQNLLTQAQTIVNTLKDYCPILIAKSSSSNGGTNNANTPSWQTAGGGKNSCATFGAEFSAASDMINNAQKIVQETQQLSANQPKNITQPHNLNLNSPSSLTALAQKMLKNAQSQAEILKLANQVESDFNKLSSGHLKDYIGKCDASAISSANMTMQNQKNNWGNGCAGVEETQSLLKTSAADFNNQTPQINQAQNLANTLIQELGNNPFRASGGGSGGGGSGKLSDTYEQLSRLLTNDNGTNSKTSAQAINQAVNNLNERAKTLAGGTTNSPAYQATLLALRSVLGLWNSMGYAVICGGYTKSPGENNQKDFHYTDENGNGTTINCGGSTNSNGTHSYNGTNTLKADKNVSLSIEQYEKIHEAYQILSKALKQAGLAPLNSKGEKLEAHVTTSKYXDFVAGIYWTVGSTYYADSAKGRFTISRDNAKNTVYLQMDSLKPEDTAVYYCAARRRGFTLAPTRANEYDYWGQGTQVTVSSLGGGSGGGGSGGGGSGGGGSGGGGSGGGGSGGGGSQELTTICEQIPSPTLESTPYSLSTTTILANGKAMQGVFEYYKSVTFVSNCGSHPSTTSKGSPINTQYVFKDNSSTSMSTIEERVKKIIGEQLGVKQEEVTNNASFVEDLGADSLDTVELVMALEEEFDTEIPDEEAEKITTVQAAIDYINGHQASEQKLISEEDL

SEQ ID NO: 109 - protein, 819 aa, Artificial Sequence
  MbNb207cHopQ_betaturnCC'_randomlinkers_Aga2p_ACP protein sequences
  misc_feature (129)..(130): Xaa can be any naturally occurring amino acid
  misc_feature (538)..(538): Xaa can be any naturally occurring amino acid
MRFPSIFTAVVFAASSALAAPANTTAEDETAQIPAEAVIGYLGLEGDSDVAALPLSDSTNNGSLSTNTTIASIAAKEEGVQLDKREAEAQVQLVESGGGLVQAGGSLRLSCAASGRTFSTAAMGWFRQXXKTTTSVIDTTNDAQNLLTQAQTIVNTLKDYCPILIAKSSSSNGGTNNANTPSWQTAGGGKNSCATFGAEFSAASDMINNAQKIVQETQQLSANQPKNITQPHNLNLNSPSSLTALAQKMLKNAQSQAEILKLANQVESDFNKLSSGHLKDYIGKCDASAISSANMTMQNQKNNWGNGCAGVEETQSLLKTSAADFNNQTPQINQAQNLANTLIQELGNNPFRASGGGSGGGGSGKLSDTYEQLSRLLTNDNGTNSKTSAQAINQAVNNLNERAKTLAGGTTNSPAYQATLLALRSVLGLWNSMGYAVICGGYTKSPGENNQKDFHYTDENGNGTTINCGGSTNSNGTHSYNGTNTLKADKNVSLSIEQYEKIHEAYQILSKALKQAGLAPLNSKGEKLEAHVTTSKYXDFVAGIYWTVGSTYYADSAKGRFTISRDNAKNTVYLQMDSLKPEDTAVYYCAARRRGFTLAPTRANEYDYWGQGTQVTVSSLGGGSGGGGSGGGGSGGGGSGGGGSGGGGSGGGGSQELTTICEQIPSPTLESTPYSLSTTTILANGKAMQGVFEYYKSVTFVSNCGSHPSTTSKGSPINTQYVFKDNSSTSMSTIEERVKKIIGEQLGVKQEEVTNNASFVEDLGADSLDTVELVMALEEEFDTEIPDEEAEKITTVQAAIDYINGHQASEQKLISEEDL

SEQ ID NO: 110 - protein, 819 aa, Artificial Sequence
  MbNb207cHopQ_betaturnCC'_randomlinkers_Aga2p_ACP protein sequences
  misc_feature (129)..(129): Xaa can be any naturally occurring amino acid
  misc_feature (537)..(538): Xaa can be any naturally occurring amino acid
MRFPSIFTAVVFAASSALAAPANTTAEDETAQIPAEAVIGYLGLEGDSDVAALPLSDSTNNGSLSTNTTIASIAAKEEGVQLDKREAEAQVQLVESGGGLVQAGGSLRLSCAASGRTFSTAAMGWFRQXKTTTSVIDTTNDAQNLLTQAQTIVNTLKDYCPILIAKSSSSNGGTNNANTPSWQTAGGGKNSCATFGAEFSAASDMINNAQKIVQETQQLSANQPKNITQPHNLNLNSPSSLTALAQKMLKNAQSQAEILKLANQVESDFNKLSSGHLKDYIGKCDASAISSANMTMQNQKNNWGNGCAGVEETQSLLKTSAADFNNQTPQINQAQNLANTLIQELGNNPFRASGGGSGGGGSGKLSDTYEQLSRLLTNDNGTNSKTSAQAINQAVNNLNERAKTLAGGTTNSPAYQATLLALRSVLGLWNSMGYAVICGGYTKSPGENNQKDFHYTDENGNGTTINCGGSTNSNGTHSYNGTNTLKADKNVSLSIEQYEKIHEAYQILSKALKQAGLAPLNSKGEKLEAHVTTSKYXXDFVAGIYWTVGSTYYADSAKGRFTISRDNAKNTVYLQMDSLKPEDTAVYYCAARRRGFTLAPTRANEYDYWGQGTQVTVSSLGGGSGGGGSGGGGSGGGGSGGGGSGGGGSGGGGSQELTTICEQIPSPTLESTPYSLSTTTILANGKAMQGVFEYYKSVTFVSNCGSHPSTTSKGSPINTQYVFKDNSSTSMSTIEERVKKIIGEQLGVKQEEVTNNASFVEDLGADSLDTVELVMALEEEFDTEIPDEEAEKITTVQAAIDYINGHQASEQKLISEEDL

SEQ ID NO: 111 - protein, 820 aa, Artificial Sequence
  MbNb207cHopQ_betaturnCC'_randomlinkers_Aga2p_ACP protein sequences
  misc_feature (129)..(130): Xaa can be any naturally occurring amino acid
  misc_feature (538)..(539): Xaa can be any naturally occurring amino acid
MRFPSIFTAVVFAASSALAAPANTTAEDETAQIPAEAVIGYLGLEGDSDVAALPLSDSTNNGSLSTNTTIASIAAKEEGVQLDKREAEAQVQLVESGGGLVQAGGSLRLSCAASGRTFSTAAMGWFRQXXKTTTSVIDTTNDAQNLLTQAQTIVNTLKDYCPILIAKSSSSNGGTNNANTPSWQTAGGGKNSCATFGAEFSAASDMINNAQKIVQETQQLSANQPKNITQPHNLNLNSPSSLTALAQKMLKNAQSQAEILKLANQVESDFNKLSSGHLKDYIGKCDASAISSANMTMQNQKNNWGNGCAGVEETQSLLKTSAADFNNQTPQINQAQNLANTLIQELGNNPFRASGGGSGGGGSGKLSDTYEQLSRLLTNDNGTNSKTSAQAINQAVNNLNERAKTLAGGTTNSPAYQATLLALRSVLGLWNSMGYAVICGGYTKSPGENNQKDFHYTDENGNGTTINCGGSTNSNGTHSYNGTNTLKADKNVSLSIEQYEKIHEAYQILSKALKQAGLAPLNSKGEKLEAHVTTSKYXXDFVAGIYWTVGSTYYADSAKGRFTISRDNAKNTVYLQMDSLKPEDTAVYYCAARRRGFTLAPTRANEYDYWGQGTQVTVSSLGGGSGGGGSGGGGSGGGGSGGGGSGGGGSGGGGSQELTTICEQIPSPTLESTPYSLSTTTILANGKAMQGVFEYYKSVTFVSNCGSHPSTTSKGSPINTQYVFKDNSSTSMSTIEERVKKIIGEQLGVKQEEVTNNASFVEDLGADSLDTVELVMALEEEFDTEIPDEEAEKITTVQAAIDYINGHQASEQKLISEEDL

SEQ ID NO: 112 - protein, 94 aa, Artificial Sequence
  Deinococcus radiodurans Monobody NS1 (from PDB5E59)
SSVPTKLEVVAATPTSLLISWDAPAVTVDYYVITYGETGGNSPVQKFEVPGSKSTATISGLKPGVDYTITVYAWGWHGQVYYYMGSPISINYRT

SEQ ID NO: 113 - protein, 511 aa, Artificial Sequence
  MbNS1cHopQ_randomlinkers
  misc_feature (14)..(14): Xaa can be any naturally occurring amino acid
  misc_feature (422)..(422): Xaa can be any naturally occurring amino acid
SSVPTKLEVVAATXKTTTSVIDTTNDAQNLLTQAQTIVNTLKDYCPILIAKSSSSNGGTNNANTPSWQTAGGGKNSCATFGAEFSAASDMINNAQKIVQETQQLSANQPKNITQPHNLNLNSPSSLTALAQKMLKNAQSQAEILKLANQVESDFNKLSSGHLKDYIGKCDASAISSANMTMQNQKNNWGNGCAGVEETQSLLKTSAADFNNQTPQINQAQNLANTLIQELGNNPFRASGGGSGGGGSGKLSDTYEQLSRLLTNDNGTNSKTSAQAINQAVNNLNERAKTLAGGTTNSPAYQATLLALRSVLGLWNSMGYAVICGGYTKSPGENNQKDFHYTDENGNGTTINCGGSTNSNGTHSYNGTNTLKADKNVSLSIEQYEKIHEAYQILSKALKQAGLAPLNSKGEKLEAHVTTSKYXSLLISWDAPAVTVDYYVITYGETGGNSPVQKFEVPGSKSTATISGLKPGVDYTITVYAWGWHGQVYYYMGSPISINYRTHHHHHHEPEA

SEQ ID NO: 114 - protein, 512 aa, Artificial Sequence
  MbNS1cHopQ_randomlinkers
  misc_feature (14)..(15): Xaa can be any naturally occurring amino acid
  misc_feature (423)..(423): Xaa can be any naturally occurring amino acid
SSVPTKLEVVAATXXKTTTSVIDTTNDAQNLLTQAQTIVNTLKDYCPILIAKSSSSNGGTNNANTPSWQTAGGGKNSCATFGAEFSAASDMINNAQKIVQETQQLSANQPKNITQPHNLNLNSPSSLTALAQKMLKNAQSQAEILKLANQVESDFNKLSSGHLKDYIGKCDASAISSANMTMQNQKNNWGNGCAGVEETQSLLKTSAADFNNQTPQINQAQNLANTLIQELGNNPFRASGGGSGGGGSGKLSDTYEQLSRLLTNDNGTNSKTSAQAINQAVNNLNERAKTLAGGTTNSPAYQATLLALRSVLGLWNSMGYAVICGGYTKSPGENNQKDFHYTDENGNGTTINCGGSTNSNGTHSYNGTNTLKADKNVSLSIEQYEKIHEAYQILSKALKQAGLAPLNSKGEKLEAHVTTSKYXSLLISWDAPAVTVDYYVITYGETGGNSPVQKFEVPGSKSTATISGLKPGVDYTITVYAWGWHGQVYYYMGSPISINYRTHHHHHHEPEA

SEQ ID NO: 115 - protein, 512 aa, Artificial Sequence
  MbNS1cHopQ_randomlinkers
  misc_feature (14)..(14): Xaa can be any naturally occurring amino acid
  misc_feature (422)..(423): Xaa can be any naturally occurring amino acid
SSVPTKLEVVAATXKTTTSVIDTTNDAQNLLTQAQTIVNTLKDYCPILIAKSSSSNGGTNNANTPSWQTAGGGKNSCATFGAEFSAASDMINNAQKIVQETQQLSANQPKNITQPHNLNLNSPSSLTALAQKMLKNAQSQAEILKLANQVESDFNKLSSGHLKDYIGKCDASAISSANMTMQNQKNNWGNGCAGVEETQSLLKTSAADFNNQTPQINQAQNLANTLIQELGNNPFRASGGGSGGGGSGKLSDTYEQLSRLLTNDNGTNSKTSAQAINQAVNNLNERAKTLAGGTTNSPAYQATLLALRSVLGLWNSMGYAVICGGYTKSPGENNQKDFHYTDENGNGTTINCGGSTNSNGTHSYNGTNTLKADKNVSLSIEQYEKIHEAYQILSKALKQAGLAPLNSKGEKLEAHVTTSKYXXSLLISWDAPAVTVDYYVITYGETGGNSPVQKFEVPGSKSTATISGLKPGVDYTITVYAWGWHGQVYYYMGSPISINYRTHHHHHHEPEA

SEQ ID NO: 116 - protein, 513 aa, Artificial Sequence
  MbNS1cHopQ_randomlinkers
  misc_feature (14)..(15): Xaa can be any naturally occurring amino acid
  misc_feature (423)..(424): Xaa can be any naturally occurring amino acid
SSVPTKLEVVAATXXKTTTSVIDTTNDAQNLLTQAQTIVNTLKDYCPILIAKSSSSNGGTNNANTPSWQTAGGGKNSCATFGAEFSAASDMINNAQKIVQETQQLSANQPKNITQPHNLNLNSPSSLTALAQKMLKNAQSQAEILKLANQVESDFNKLSSGHLKDYIGKCDASAISSANMTMQNQKNNWGNGCAGVEETQSLLKTSAADFNNQTPQINQAQNLANTLIQELGNNPFRASGGGSGGGGSGKLSDTYEQLSRLLTNDNGTNSKTSAQAINQAVNNLNERAKTLAGGTTNSPAYQATLLALRSVLGLWNSMGYAVICGGYTKSPGENNQKDFHYTDENGNGTTINCGGSTNSNGTHSYNGTNTLKADKNVSLSIEQYEKIHEAYQILSKALKQAGLAPLNSKGEKLEAHVTTSKYXXSLLISWDAPAVTVDYYVITYGETGGNSPVQKFEVPGSKSTATISGLKPGVDYTITVYAWGWHGQVYYYMGSPISINYRTHHHHHHEPEA

SEQ ID NO: 117 - protein, 790 aa, Artificial Sequence
  MbNS1cHopQ_randomlinkers _Aga2p_ACP protein sequences
  misc_feature (103)..(103): Xaa can be any naturally occurring amino acid
  misc_feature (511)..(511): Xaa can be any naturally occurring amino acid
MRFPSIFTAVVFAASSALAAPANTTAEDETAQIPAEAVIGYLGLEGDSDVAALPLSDSTNNGSLSTNTTIASIAAKEEGVQLDKREAEASSVPTKLEVVAATXKTTTSVIDTTNDAQNLLTQAQTIVNTLKDYCPILIAKSSSSNGGTNNANTPSWQTAGGGKNSCATFGAEFSAASDMINNAQKIVQETQQLSANQPKNITQPHNLNLNSPSSLTALAQKMLKNAQSQAEILKLANQVESDFNKLSSGHLKDYIGKCDASAISSANMTMQNQKNNWGNGCAGVEETQSLLKTSAADFNNQTPQINQAQNLANTLIQELGNNPFRASGGGSGGGGSGKLSDTYEQLSRLLTNDNGTNSKTSAQAINQAVNNLNERAKTLAGGTTNSPAYQATLLALRSVLGLWNSMGYAVICGGYTKSPGENNQKDFHYTDENGNGTTINCGGSTNSNGTHSYNGTNTLKADKNVSLSIEQYEKIHEAYQILSKALKQAGLAPLNSKGEKLEAHVTTSKYXSLLISWDAPAVTVDYYVITYGETGGNSPVQKFEVPGSKSTATISGLKPGVDYTITVYAWGWHGQVYYYMGSPISINYRTSLGGGSGGGGSGGGGSGGGGSGGGGSGGGGSGGGGSQELTTICEQIPSPTLESTPYSLSTTTILANGKAMQGVFEYYKSVTFVSNCGSHPSTTSKGSPINTQYVFKDNSSTSMSTIEERVKKIIGEQLGVKQEEVTNNASFVEDLGADSLDTVELVMALEEEFDTEIPDEEAEKITTVQAAIDYINGHQASEQKLISEED

SEQ ID NO: 118 - protein, 791 aa, Artificial Sequence
  MbNS1cHopQ_randomlinkers _Aga2p_ACP protein sequences
  misc_feature (103)..(104): Xaa can be any naturally occurring amino acid
  misc_feature (512)..(512): Xaa can be any naturally occurring amino acid
MRFPSIFTAVVFAASSALAAPANTTAEDETAQIPAEAVIGYLGLEGDSDVAALPLSDSTNNGSLSTNTTIASIAAKEEGVQLDKREAEASSVPTKLEVVAATXXKTTTSVIDTTNDAQNLLTQAQTIVNTLKDYCPILIAKSSSSNGGTNNANTPSWQTAGGGKNSCATFGAEFSAASDMINNAQKIVQETQQLSANQPKNITQPHNLNLNSPSSLTALAQKMLKNAQSQAEILKLANQVESDFNKLSSGHLKDYIGKCDASAISSANMTMQNQKNNWGNGCAGVEETQSLLKTSAADFNNQTPQINQAQNLANTLIQELGNNPFRASGGGSGGGGSGKLSDTYEQLSRLLTNDNGTNSKTSAQAINQAVNNLNERAKTLAGGTTNSPAYQATLLALRSVLGLWNSMGYAVICGGYTKSPGENNQKDFHYTDENGNGTTINCGGSTNSNGTHSYNGTNTLKADKNVSLSIEQYEKIHEAYQILSKALKQAGLAPLNSKGEKLEAHVTTSKYXSLLISWDAPAVTVDYYVITYGETGGNSPVQKFEVPGSKSTATISGLKPGVDYTITVYAWGWHGQVYYYMGSPISINYRTSLGGGSGGGGSGGGGSGGGGSGGGGSGGGGSGGGGSQELTTICEQIPSPTLESTPYSLSTTTILANGKAMQGVFEYYKSVTFVSNCGSHPSTTSKGSPINTQYVFKDNSSTSMSTIEERVKKIIGEQLGVKQEEVTNNASFVEDLGADSLDTVELVMALEEEFDTEIPDEEAEKITTVQAAIDYINGHQASEQKLISEED

SEQ ID NO: 119 - protein, 791 aa, Artificial Sequence
  MbNS1cHopQ_randomlinkers _Aga2p_ACP protein sequences
  misc_feature (103)..(103): Xaa can be any naturally occurring amino acid
  misc_feature (511)..(512): Xaa can be any naturally occurring amino acid
MRFPSIFTAVVFAASSALAAPANTTAEDETAQIPAEAVIGYLGLEGDSDVAALPLSDSTNNGSLSTNTTIASIAAKEEGVQLDKREAEASSVPTKLEVVAATXKTTTSVIDTTNDAQNLLTQAQTIVNTLKDYCPILIAKSSSSNGGTNNANTPSWQTAGGGKNSCATFGAEFSAASDMINNAQKIVQETQQLSANQPKNITQPHNLNLNSPSSLTALAQKMLKNAQSQAEILKLANQVESDFNKLSSGHLKDYIGKCDASAISSANMTMQNQKNNWGNGCAGVEETQSLLKTSAADFNNQTPQINQAQNLANTLIQELGNNPFRASGGGSGGGGSGKLSDTYEQLSRLLTNDNGTNSKTSAQAINQAVNNLNERAKTLAGGTTNSPAYQATLLALRSVLGLWNSMGYAVICGGYTKSPGENNQKDFHYTDENGNGTTINCGGSTNSNGTHSYNGTNTLKADKNVSLSIEQYEKIHEAYQILSKALKQAGLAPLNSKGEKLEAHVTTSKYXXSLLISWDAPAVTVDYYVITYGETGGNSPVQKFEVPGSKSTATISGLKPGVDYTITVYAWGWHGQVYYYMGSPISINYRTSLGGGSGGGGSGGGGSGGGGSGGGGSGGGGSGGGGSQELTTICEQIPSPTLESTPYSLSTTTILANGKAMQGVFEYYKSVTFVSNCGSHPSTTSKGSPINTQYVFKDNSSTSMSTIEERVKKIIGEQLGVKQEEVTNNASFVEDLGADSLDTVELVMALEEEFDTEIPDEEAEKITTVQAAIDYINGHQASEQKLISEED

SEQ ID NO: 120 - protein, 792 aa, Artificial Sequence
  MbNS1cHopQ_randomlinkers _Aga2p_ACP protein sequences
  misc_feature (103)..(104): Xaa can be any naturally occurring amino acid
  misc_feature (512)..(513): Xaa can be any naturally occurring amino acid
MRFPSIFTAVVFAASSALAAPANTTAEDETAQIPAEAVIGYLGLEGDSDVAALPLSDSTNNGSLSTNTTIASIAAKEEGVQLDKREAEASSVPTKLEVVAATXXKTTTSVIDTTNDAQNLLTQAQTIVNTLKDYCPILIAKSSSSNGGTNNANTPSWQTAGGGKNSCATFGAEFSAASDMINNAQKIVQETQQLSANQPKNITQPHNLNLNSPSSLTALAQKMLKNAQSQAEILKLANQVESDFNKLSSGHLKDYIGKCDASAISSANMTMQNQKNNWGNGCAGVEETQSLLKTSAADFNNQTPQINQAQNLANTLIQELGNNPFRASGGGSGGGGSGKLSDTYEQLSRLLTNDNGTNSKTSAQAINQAVNNLNERAKTLAGGTTNSPAYQATLLALRSVLGLWNSMGYAVICGGYTKSPGENNQKDFHYTDENGNGTTINCGGSTNSNGTHSYNGTNTLKADKNVSLSIEQYEKIHEAYQILSKALKQAGLAPLNSKGEKLEAHVTTSKYXXSLLISWDAPAVTVDYYVITYGETGGNSPVQKFEVPGSKSTATISGLKPGVDYTITVYAWGWHGQVYYYMGSPISINYRTSLGGGSGGGGSGGGGSGGGGSGGGGSGGGGSGGGGSQELTTICEQIPSPTLESTPYSLSTTTILANGKAMQGVFEYYKSVTFVSNCGSHPSTTSKGSPINTQYVFKDNSSTSMSTIEERVKKIIGEQLGVKQEEVTNNASFVEDLGADSLDTVELVMALEEEFDTEIPDEEAEKITTVQAAIDYINGHQASEQKLISEED

SEQ ID NO: 121 - DNA, 378 bp, Artificial Sequence
  NbGFP207
caggtgcagctggtggagtctggaggaggattggtgcaggctgggggctctctgagactctcctgtgcagcctctggacgcaccttcagtaccgctgccatgggctggttccgccaggctccaggaaaggagcgtgacttcgtagcaggtatttactggactgttggcagcacatactatgcagactccgcgaagggccgattcaccatctccagagacaacgccaagaacacggtgtatctgcaaatggacagcctgaaaccagaggacacggccgtttattactgtgcagctaggcggaggggctttactttagcccctactcgagcaaatgaatatgactactggggtcaggggacccaggtcaccgtctccagc

SEQ ID NO: 122 - DNA, 31 bp, Artificial Sequence
  TU89 Forward primer (SapI digestion site)
ccttgagctcttcgtccctgagactctcctg

SEQ ID NO: 123 - DNA, 35 bp, Artificial Sequence
  EP230 Reverse primer (SapI digestion site)
aggactgctcttccactggagacggtgacctgggt

SEQ ID NO: 124 - DNA, 45 bp, Artificial Sequence
  TU64 primer
ccctccaccagagccacctcccaagcttgagacggtgacctgggt

SEQ ID NO: 125 - DNA, 42 bp, Artificial Sequence
  TU65 primer
gcatgtaaccacatcaaagtatggatccctgagactctcctg

SEQ ID NO: 126 - DNA, 52 bp, Artificial Sequence
  TU131 primer
  misc_feature (28)..(29): n is a, c, g, or t
ctggtggagtctgggggaggactagtannkaaaacaacaacttctgttattg

SEQ ID NO: 127 - DNA, 55 bp, Artificial Sequence
  TU132 primer
  misc_feature (28)..(29): n is a, c, g, or t
  misc_feature (31)..(32): n is a, c, g, or t
ctggtggagtctgggggaggactagtannknnkaaaacaacaacttctgttattg

SEQ ID NO: 128 - DNA, 51 bp, Artificial Sequence
  TU133 primer
  misc_feature (29)..(30): n is a, c, g, or t
agaggctgcacaggagagtctcagggamnnctttgatgtggttacatgtgc

SEQ ID NO: 129 - DNA, 54 bp, Artificial Sequence
  TU134 primer
  misc_feature (29)..(30): n is a, c, g, or t
  misc_feature (32)..(33): n is a, c, g, or t
agaggctgcacaggagagtctcagggamnnmnnctttgatgtggttacatgtgc

SEQ ID NO: 130 - protein, 123 aa, Artificial Sequence
  Nb38 GABAA-specific Nanobody
QVQLQESGGGLVQAGGSLRVSCAASGRTFTTYIMAWFRQAPGKEREFLAAMDQGRIQYYGDSVRGRFTISRDYAKNSVDLQLDGLRPEDTAVYYCAAGAGFWGLRTASSYHYWGQGTQVTVSS

SEQ ID NO: 131 - protein, 539 aa, Artificial Sequence
  MbNb38cHopQ
QVQLVESGGGLVQTKTTTSVIDTTNDAQNLLTQAQTIVNTLKDYCPILIAKSSSSNGGTNNANTPSWQTAGGGKNSCATFGAEFSAASDMINNAQKIVQETQQLSANQPKNITQPHNLNLNSPSSLTALAQKMLKNAQSQAEILKLANQVESDFNKLSSGHLKDYIGKCDASAISSANMTMQNQKNNWGNGCAGVEETQSLLKTSAADFNNQTPQINQAQNLANTLIQELGNNPFRASGGGSGGGGSGKLSDTYEQLSRLLTNDNGTNSKTSAQAINQAVNNLNERAKTLAGGTTNSPAYQATLLALRSVLGLWNSMGYAVICGGYTKSPGENNQKDFHYTDENGNGTTINCGGSTNSNGTHSYNGTNTLKADKNVSLSIEQYEKIHEAYQILSKALKQAGLAPLNSKGEKLEAHVTTSKYGSLRLSCAASGRTFTTYIMAWFRQAPGKEREFLAAMDQGRIQYYGDSVRGRFTISRDYAKNSVDLQLDGLRPEDTAVYYCAAGAGFWGLRTASSYHYWGQGTQVTVSSHHHHHHEPEA

SEQ ID NO: 132 - protein, 133 aa, Artificial Sequence
  Nb60 HopQ-specific Nanobody
QVQLQESGGGLVQPGGSLRLSCAASGFTFSRYAMSWVRQAPGKGPEWVSAINSPGGSTSYADSVKGRFTISRDNAKNTLYLQMNSLKPDDTAVYYCAKYERATEWGHTIVAVTPLLDGVHDYWGQGTQVTVSS

SEQ ID NO: 133 - protein, 530 aa, Artificial Sequence
  MbNb60c7HopQ N277K T270R
QVQLVESGGGLVQTKTTTSVIDTTNDAQNLLTQAQTIVNTLKDYCPILIAKSSSSNGGTNNANTPSWQTAGGGKNSCATFGAEFSAASDMINNAQKIVQETQQLSANQPKNITQPHNLNLNSPSSLTALAQKMLKNAQSQAEILKLANQVESDFNKLSSGHLKDYIGKCDASAISSANMTMQNQKNNWGNGCAGVEETQSLLKTSAADFNNQTPQINQAQNLANTLIQELGNNTYEQLSRLLTNDNGTNSKTSAQAINQAVNNLNERAKRLAGGTTKSPAYQATLLALRSVLGLWNSMGYAVICGGYTKSPGENNQKDFHYTDENGNGTTINCGGSTNSNGTHSYNGTNTLKADKNVSLSIEQYEKIHEAYQILSKALKQAGLAPLNSKGEKLEAHVTTSKYGSLRLSCAASGFTFSRYAMSWVRQAPGKGPEWVSAINSPGGSTSYADSVKGRFTISRDNAKNTLYLQMNSLKPDDTAVYYCAKYERATEWGHTIVAVTPLLDGVHDYWGQGTQVTVSSHHHHHHEPEA

SEQ ID NO: 134 - protein, 530 aa, Artificial Sequence
  MbNb60c7HopQ N277K T270R E197R
QVQLVESGGGLVQTKTTTSVIDTTNDAQNLLTQAQTIVNTLKDYCPILIAKSSSSNGGTNNANTPSWQTAGGGKNSCATFGAEFSAASDMINNAQKIVQETQQLSANQPKNITQPHNLNLNSPSSLTALAQKMLKNAQSQAEILKLANQVESDFNKLSSGHLKDYIGKCDASAISSANMTMQNQKNNWGNGCAGVERTQSLLKTSAADFNNQTPQINQAQNLANTLIQELGNNTYEQLSRLLTNDNGTNSKTSAQAINQAVNNLNERAKRLAGGTTKSPAYQATLLALRSVLGLWNSMGYAVICGGYTKSPGENNQKDFHYTDENGNGTTINCGGSTNSNGTHSYNGTNTLKADKNVSLSIEQYEKIHEAYQILSKALKQAGLAPLNSKGEKLEAHVTTSKYGSLRLSCAASGFTFSRYAMSWVRQAPGKGPEWVSAINSPGGSTSYADSVKGRFTISRDNAKNTLYLQMNSLKPDDTAVYYCAKYERATEWGHTIVAVTPLLDGVHDYWGQGTQVTVSSHHHHHHEPEA

SEQ ID NO: 135 - protein, 916 aa, Artificial Sequence
  MbNb60cYgjkQE2
QVQLVESGGGLVYKEETQSGLNNYARVVEKGQYDSLEIPAQVAASWESGRDDAAVFGFIDKEQLDKYVANGGKRSDWTVKFAENRSQDGTLLGYSLLQESVDQASYMYSDNHYLAEMATILGKPEEAKRYRQLAQQLADYINTCMFDPTTQFYYDVRIEDKPLANGCAGKPIVERGKGPEGWSPLFNGAATQANADAVVKVMLDPKEFNTFVPLGTAALTNPAFGADIYWRGRVWVDQFWFGLKGMERYGYRDDALKLADTFFRHAKGLTADGPIQENYNPLTGAQQGAPNFSWSAAHLYMLYNDFFRKQASGGGSGGGGSGGGGSGNADNYKNVINRTGAPQYMKDYDYDDHQRFNPFFDLGAWHGHLLPDGPNTMGGFPGVALLTEEYINFMASNFDRLTVWQDGKKVDFTLEAYSIPGALVQKLTAKDVQVEMTLRFATPRTSLLETKITSNKPLDLVWDGELLEKLEAKEGKPLSDKTIAGEYPDYQRKISATRDGLKVTFGKVRATWDLLTSGESEYQVHKSLPVQTEINGNRFTSKAHINGSTTLYTTYSHLLTAQEVSKEQMQIRDILARPAFYLTASQQRWEEYLKKGLTNPDATPEQTRVAVKAIETLNGNWRSPGGAVKFNTVTPSVTGRWFSGNQTWPWDTWKQAFAMAHFNPDIAKENIRAVFSWQIQPGDSVRPQDVGFVPDLIAWNLSPERGGDGGNWNERNTKPSLAAWSVMEVYNVTQDKTWVAEMYPKLVAYHDWWLRNRDHNGNGVPEYGATRDKAHNTESGEMLFTVKKDSLRLSCAASGFTFSRYAMSWVRQAPGKGPEWVSAINSPGGSTSYADSVKGRFTISRDNAKNTLYLQMNSLKPDDTAVYYCAKYERATEWGHTIVAVTPLLDGVHDYWGQGTQVTVSSHHHHHHEPEA

SEQ ID NO: 136 - protein, 523 aa, Artificial Sequence
  MbNb207c7HopQ
QVQLVESGGGLVQTKTTTSVIDTTNDAQNLLTQAQTIVNTLKDYCPILIAKSSSSNGGTNNANTPSWQTAGGGKNSCATFGAEFSAASDMINNAQKIVQETQQLSANQPKNITQPHNLNLNSPSSLTALAQKMLKNAQSQAEILKLANQVESDFNKLSSGHLKDYIGKCDASAISSANMTMQNQKNNWGNGCAGVEETQSLLKTSAADFNNQTPQINQAQNLANTLIQELGNNTYEQLSRLLTNDNGTNSKTSAQAINQAVNNLNERAKTLAGGTTNSPAYQATLLALRSVLGLWNSMGYAVICGGYTKSPGENNQKDFHYTDENGNGTTINCGGSTNSNGTHSYNGTNTLKADKNVSLSIEQYEKIHEAYQILSKALKQAGLAPLNSKGEKLEAHVTTSKYGSLRLSCAASGRTFSTAAMGWFRQAPGKERDFVAGIYWTVGSTYYADSAKGRFTISRDNAKNTVYLQMDSLKPEDTAVYYCAARRRGFTLAPTRANEYDYWGQGTQVTVSSHHHHHHEPEA

SEQ ID NO: 137 - protein, 521 aa, Artificial Sequence
  MbNb207c7HopQA5
QVQLVESGGGLVAKTTTSVIDTTNDAQNLLTQAQTIVNTLKDYCPILIAKSSSSNGGTNNANTPSWQTAGGGKNSCATFGAEFSAASDMINNAQKIVQETQQLSANQPKNITQPHNLNLNSPSSLTALAQKMLKNAQSQAEILKLANQVESDFNKLSSGHLKDYIGKCDASAISSANMTMQNQKNNWGNGCAGVEETQSLLKTSAADFNNQTPQINQAQNLANTLIQELGNNTYEQLSRLLTNDNGTNSKTSAQAINQAVNNLNERAKTLAGGTTNSPAYQATLLALRSVLGLWNSMGYAVICGGYTKSPGENNQKDFHYTDENGNGTTINCGGSTNSNGTHSYNGTNTLKADKNVSLSIEQYEKIHEAYQILSKALKQAGLAPLNSKGEKLEAHVTTSKMSLRLSCAASGRTFSTAAMGWFRQAPGKERDFVAGIYWTVGSTYYADSAKGRFTISRDNAKNTVYLQMDSLKPEDTAVYYCAARRRGFTLAPTRANEYDYWGQGTQVTVSSHHHHHHEPEA

SEQ ID NO: 138 - protein, 521 aa, Artificial Sequence
  MbNb207c7HopQA12
QVQLVESGGGLVRKTTTSVIDTTNDAQNLLTQAQTIVNTLKDYCPILIAKSSSSNGGTNNANTPSWQTAGGGKNSCATFGAEFSAASDMINNAQKIVQETQQLSANQPKNITQPHNLNLNSPSSLTALAQKMLKNAQSQAEILKLANQVESDFNKLSSGHLKDYIGKCDASAISSANMTMQNQKNNWGNGCAGVEETQSLLKTSAADFNNQTPQINQAQNLANTLIQELGNNTYEQLSRLLTNDNGTNSKTSAQAINQAVNNLNERAKTLAGGTTNSPAYQATLLALRSVLGLWNSMGYAVICGGYTKSPGENNQKDFHYTDENGNGTTINCGGSTNSNGTHSYNGTNTLKADKNVSLSIEQYEKIHEAYQILSKALKQAGLAPLNSKGEKLEAHVTTSKPSLRLSCAASGRTFSTAAMGWFRQAPGKERDFVAGIYWTVGSTYYADSAKGRFTISRDNAKNTVYLQMDSLKPEDTAVYYCAARRRGFTLAPTRANEYDYWGQGTQVTVSSHHHHHHEPEA

SEQ ID NO: 139 - protein, 521 aa, Artificial Sequence
  MbNb207c7HopQB7
QVQLVESGGGLVYKTTTSVIDTTNDAQNLLTQAQTIVNTLKDYCPILIAKSSSSNGGTNNANTPSWQTAGGGKNSCATFGAEFSAASDMINNAQKIVQETQQLSANQPKNITQPHNLNLNSPSSLTALAQKMLKNAQSQAEILKLANQVESDFNKLSSGHLKDYIGKCDASAISSANMTMQNQKNNWGNGCAGVEETQSLLKTSAADFNNQTPQINQAQNLANTLIQELGNNTYEQLSRLLTNDNGTNSKTSAQAINQAVNNLNERAKTLAGGTTNSPAYQATLLALRSVLGLWNSMGYAVICGGYTKSPGENNQKDFHYTDENGNGTTINCGGSTNSNGTHSYNGTNTLKADKNVSLSIEQYEKIHEAYQILSKALKQAGLAPLNSKGEKLEAHVTTSKRSLRLSCAASGRTFSTAAMGWFRQAPGKERDFVAGIYWTVGSTYYADSAKGRFTISRDNAKNTVYLQMDSLKPEDTAVYYCAARRRGFTLAPTRANEYDYWGQGTQVTVSSHHHHHHEPEA

SEQ ID NO: 140 - protein, 521 aa, Artificial Sequence
  MbNb207c7HopQG10
QVQLVESGGGLVLKTTTSVIDTTNDAQNLLTQAQTIVNTLKDYCPILIAKSSSSNGGTNNANTPSWQTAGGGKNSCATFGAEFSAASDMINNAQKIVQETQQLSANQPKNITQPHNLNLNSPSSLTALAQKMLKNAQSQAEILKLANQVESDFNKLSSGHLKDYIGKCDASAISSANMTMQNQKNNWGNGCAGVEETQSLLKTSAADFNNQTPQINQAQNLANTLIQELGNNTYEQLSRLLTNDNGTNSKTSAQAINQAVNNLNERAKTLAGGTTNSPAYQATLLALRSVLGLWNSMGYAVICGGYTKSPGENNQKDFHYTDENGNGTTINCGGSTNSNGTHSYNGTNTLKADKNVSLSIEQYEKIHEAYQILSKALKQAGLAPLNSKGEKLEAHVTTSKSSLRLSCAASGRTFSTAAMGWFRQAPGKERDFVAGIYWTVGSTYYADSAKGRFTISRDNAKNTVYLQMDSLKPEDTAVYYCAARRRGFTLAPTRANEYDYWGQGTQVTVSSHHHHHHEPEA

SEQ ID NO: 141 - protein, 909 aa, Artificial Sequence
  MbNb207cYgjkE2
QVQLVESGGGLVYKEETQSGLNNYARVVEKGQYDSLEIPAQVAASWESGRDDAAVFGFIDKEQLDKYVANGGKRSDWTVKFAENRSQDGTLLGYSLLQESVDQASYMYSDNHYLAEMATILGKPEEAKRYRQLAQQLADYINTCMFDPTTQFYYDVRIEDKPLANGCAGKPIVERGKGPEGWSPLFNGAATQANADAVVKVMLDPKEFNTFVPLGTAALTNPAFGADIYWRGRVWVDQFWFGLKGMERYGYRDDALKLADTFFRHAKGLTADGPIQENYNPLTGAQQGAPNFSWSAAHLYMLYNDFFRKQASGGGSGGGGSGGGGSGNADNYKNVINRTGAPQYMKDYDYDDHQRFNPFFDLGAWHGHLLPDGPNTMGGFPGVALLTEEYINFMASNFDRLTVWQDGKKVDFTLEAYSIPGALVQKLTAKDVQVEMTLRFATPRTSLLETKITSNKPLDLVWDGELLEKLEAKEGKPLSDKTIAGEYPDYQRKISATRDGLKVTFGKVRATWDLLTSGESEYQVHKSLPVQTEINGNRFTSKAHINGSTTLYTTYSHLLTAQEVSKEQMQIRDILARPAFYLTASQQRWEEYLKKGLTNPDATPEQTRVAVKAIETLNGNWRSPGGAVKFNTVTPSVTGRWFSGNQTWPWDTWKQAFAMAHFNPDIAKENIRAVFSWQIQPGDSVRPQDVGFVPDLIAWNLSPERGGDGGNWNERNTKPSLAAWSVMEVYNVTQDKTWVAEMYPKLVAYHDWWLRNRDHNGNGVPEYGATRDKAHNTESGEMLFTVKKDSLRLSCAASGRTFSTAAMGWFRQAPGKERDFVAGIYWTVGSTYYADSAKGRFTISRDNAKNTVYLQMDSLKPEDTAVYYCAARRRGFTLAPTRANEYDYWGQGTQVTVSSHHHHHHEPEA

SEQ ID NO: 142 - protein, 910 aa, Artificial Sequence
  MbNb207cYgjkA2
QVQLVESGGGLVEKEETQSGLNNYARVVEKGQYDSLEIPAQVAASWESGRDDAAVFGFIDKEQLDKYVANGGKRSDWTVKFAENRSQDGTLLGYSLLQESVDQASYMYSDNHYLAEMATILGKPEEAKRYRQLAQQLADYINTCMFDPTTQFYYDVRIEDKPLANGCAGKPIVERGKGPEGWSPLFNGAATQANADAVVKVMLDPKEFNTFVPLGTAALTNPAFGADIYWRGRVWVDQFWFGLKGMERYGYRDDALKLADTFFRHAKGLTADGPIQENYNPLTGAQQGAPNFSWSAAHLYMLYNDFFRKQASGGGSGGGGSGGGGSGNADNYKNVINRTGAPQYMKDYDYDDHQRFNPFFDLGAWHGHLLPDGPNTMGGFPGVALLTEEYINFMASNFDRLTVWQDGKKVDFTLEAYSIPGALVQKLTAKDVQVEMTLRFATPRTSLLETKITSNKPLDLVWDGELLEKLEAKEGKPLSDKTIAGEYPDYQRKISATRDGLKVTFGKVRATWDLLTSGESEYQVHKSLPVQTEINGNRFTSKAHINGSTTLYTTYSHLLTAQEVSKEQMQIRDILARPAFYLTASQQRWEEYLKKGLTNPDATPEQTRVAVKAIETLNGNWRSPGGAVKFNTVTPSVTGRWFSGNQTWPWDTWKQAFAMAHFNPDIAKENIRAVFSWQIQPGDSVRPQDVGFVPDLIAWNLSPERGGDGGNWNERNTKPSLAAWSVMEVYNVTQDKTWVAEMYPKLVAYHDWWLRNRDHNGNGVPEYGATRDKAHNTESGEMLFTVKKGDSLRLSCAASGRTFSTAAMGWFRQAPGKERDFVAGIYWTVGSTYYADSAKGRFTISRDNAKNTVYLQMDSLKPEDTAVYYCAARRRGFTLAPTRANEYDYWGQGTQVTVSSHHHHHHEPEA

SEQ ID NO: 143 - protein, 910 aa, Artificial Sequence
  MbNb207cYgjkC4
QVQLVESGGGLVMYKEETQSGLNNYARVVEKGQYDSLEIPAQVAASWESGRDDAAVFGFIDKEQLDKYVANGGKRSDWTVKFAENRSQDGTLLGYSLLQESVDQASYMYSDNHYLAEMATILGKPEEAKRYRQLAQQLADYINTCMFDPTTQFYYDVRIEDKPLANGCAGKPIVERGKGPEGWSPLFNGAATQANADAVVKVMLDPKEFNTFVPLGTAALTNPAFGADIYWRGRVWVDQFWFGLKGMERYGYRDDALKLADTFFRHAKGLTADGPIQENYNPLTGAQQGAPNFSWSAAHLYMLYNDFFRKQASGGGSGGGGSGGGGSGNADNYKNVINRTGAPQYMKDYDYDDHQRFNPFFDLGAWHGHLLPDGPNTMGGFPGVALLTEEYINFMASNFDRLTVWQDGKKVDFTLEAYSIPGALVQKLTAKDVQVEMTLRFATPRTSLLETKITSNKPLDLVWDGELLEKLEAKEGKPLSDKTIAGEYPDYQRKISATRDGLKVTFGKVRATWDLLTSGESEYQVHKSLPVQTEINGNRFTSKAHINGSTTLYTTYSHLLTAQEVSKEQMQIRDILARPAFYLTASQQRWEEYLKKGLTNPDATPEQTRVAVKAIETLNGNWRSPGGAVKFNTVTPSVTGRWFSGNQTWPWDTWKQAFAMAHFNPDIAKENIRAVFSWQIQPGDSVRPQDVGFVPDLIAWNLSPERGGDGGNWNERNTKPSLAAWSVMEVYNVTQDKTWVAEMYPKLVAYHDWWLRNRDHNGNGVPEYGATRDKAHNTESGEMLFTVKKNSLRLSCAASGRTFSTAAMGWFRQAPGKERDFVAGIYWTVGSTYYADSAKGRFTISRDNAKNTVYLQMDSLKPEDTAVYYCAARRRGFTLAPTRANEYDYWGQGTQVTVSSHHHHHHEPEA

SEQ ID NO: 144 - protein, 911 aa, Artificial Sequence
  MbNb207cYgjkF5
QVQLVESGGGLVWTKEETQSGLNNYARVVEKGQYDSLEIPAQVAASWESGRDDAAVFGFIDKEQLDKYVANGGKRSDWTVKFAENRSQDGTLLGYSLLQESVDQASYMYSDNHYLAEMATILGKPEEAKRYRQLAQQLADYINTCMFDPTTQFYYDVRIEDKPLANGCAGKPIVERGKGPEGWSPLFNGAATQANADAVVKVMLDPKEFNTFVPLGTAALTNPAFGADIYWRGRVWVDQFWFGLKGMERYGYRDDALKLADTFFRHAKGLTADGPIQENYNPLTGAQQGAPNFSWSAAHLYMLYNDFFRKQASGGGSGGGGSGGGGSGNADNYKNVINRTGAPQYMKDYDYDDHQRFNPFFDLGAWHGHLLPDGPNTMGGFPGVALLTEEYINFMASNFDRLTVWQDGKKVDFTLEAYSIPGALVQKLTAKDVQVEMTLRFATPRTSLLETKITSNKPLDLVWDGELLEKLEAKEGKPLSDKTIAGEYPDYQRKISATRDGLKVTFGKVRATWDLLTSGESEYQVHKSLPVQTEINGNRFTSKAHINGSTTLYTTYSHLLTAQEVSKEQMQIRDILARPAFYLTASQQRWEEYLKKGLTNPDATPEQTRVAVKAIETLNGNWRSPGGAVKFNTVTPSVTGRWFSGNQTWPWDTWKQAFAMAHFNPDIAKENIRAVFSWQIQPGDSVRPQDVGFVPDLIAWNLSPERGGDGGNWNERNTKPSLAAWSVMEVYNVTQDKTWVAEMYPKLVAYHDWWLRNRDHNGNGVPEYGATRDKAHNTESGEMLFTVKKGASLRLSCAASGRTFSTAAMGWFRQAPGKERDFVAGIYWTVGSTYYADSAKGRFTISRDNAKNTVYLQMDSLKPEDTAVYYCAARRRGFTLAPTRANEYDYWGQGTQVTVSSHHHHHHEPEA

SEQ ID NO: 145 - protein, 523 aa, Artificial Sequence
  MbNb207c7HopQ C14-C512
QVQLVESGGGLVQCKTTTSVIDTTNDAQNLLTQAQTIVNTLKDYCPILIAKSSSSNGGTNNANTPSWQTAGGGKNSCATFGAEFSAASDMINNAQKIVQETQQLSANQPKNITQPHNLNLNSPSSLTALAQKMLKNAQSQAEILKLANQVESDFNKLSSGHLKDYIGKCDASAISSANMTMQNQKNNWGNGCAGVEETQSLLKTSAADFNNQTPQINQAQNLANTLIQELGNNTYEQLSRLLTNDNGTNSKTSAQAINQAVNNLNERAKTLAGGTTNSPAYQATLLALRSVLGLWNSMGYAVICGGYTKSPGENNQKDFHYTDENGNGTTINCGGSTNSNGTHSYNGTNTLKADKNVSLSIEQYEKIHEAYQILSKALKQAGLAPLNSKGEKLEAHVTTSKYGSLRLSCAASGRTFSTAAMGWFRQAPGKERDFVAGIYWTVGSTYYADSAKGRFTISRDNAKNTVYLQMDSLKPEDTAVYYCAARRRGFTLAPTRANEYDYWGQGTQVTVCSHHHHHHEPEA

SEQ ID NO: 146 - protein, 523 aa, Artificial Sequence
  MbNb207c7HopQ C402-C474
QVQLVESGGGLVQTKTTTSVIDTTNDAQNLLTQAQTIVNTLKDYCPILIAKSSSSNGGTNNANTPSWQTAGGGKNSCATFGAEFSAASDMINNAQKIVQETQQLSANQPKNITQPHNLNLNSPSSLTALAQKMLKNAQSQAEILKLANQVESDFNKLSSGHLKDYIGKCDASAISSANMTMQNQKNNWGNGCAGVEETQSLLKTSAADFNNQTPQINQAQNLANTLIQELGNNTYEQLSRLLTNDNGTNSKTSAQAINQAVNNLNERAKTLAGGTTNSPAYQATLLALRSVLGLWNSMGYAVICGGYTKSPGENNQKDFHYTDENGNGTTINCGGSTNSNGTHSYNGTNTLKADKNVSLSIEQYEKIHEAYQILSKALKQAGLAPLNSKGEKLEAHVTTSKCGSLRLSCAASGRTFSTAAMGWFRQAPGKERDFVAGIYWTVGSTYYADSAKGRFTISRDNAKNTVYLQMDSLCPEDTAVYYCAARRRGFTLAPTRANEYDYWGQGTQVTVSSHHHHHHEPEA

SEQ ID NO: 147 - protein, 523 aa, Artificial Sequence
  MbNb207c7HopQ C316-C472
QVQLVESGGGLVQTKTTTSVIDTTNDAQNLLTQAQTIVNTLKDYCPILIAKSSSSNGGTNNANTPSWQTAGGGKNSCATFGAEFSAASDMINNAQKIVQETQQLSANQPKNITQPHNLNLNSPSSLTALAQKMLKNAQSQAEILKLANQVESDFNKLSSGHLKDYIGKCDASAISSANMTMQNQKNNWGNGCAGVEETQSLLKTSAADFNNQTPQINQAQNLANTLIQELGNNTYEQLSRLLTNDNGTNSKTSAQAINQAVNNLNERAKTLAGGTTNSPAYQATLLALRSVLGLWNSMGYAVICGGYTKSPGENNCKDFHYTDENGNGTTINCGGSTNSNGTHSYNGTNTLKADKNVSLSIEQYEKIHEAYQILSKALKQAGLAPLNSKGEKLEAHVTTSKYGSLRLSCAASGRTFSTAAMGWFRQAPGKERDFVAGIYWTVGSTYYADSAKGRFTISRDNAKNTVYLQMDCLKPEDTAVYYCAARRRGFTLAPTRANEYDYWGQGTQVTVSSHHHHHHEPEA

SEQ ID NO: 148 - protein, 523 aa, Artificial Sequence
  MbNb207c7HopQ C314-C472
QVQLVESGGGLVQTKTTTSVIDTTNDAQNLLTQAQTIVNTLKDYCPILIAKSSSSNGGTNNANTPSWQTAGGGKNSCATFGAEFSAASDMINNAQKIVQETQQLSANQPKNITQPHNLNLNSPSSLTALAQKMLKNAQSQAEILKLANQVESDFNKLSSGHLKDYIGKCDASAISSANMTMQNQKNNWGNGCAGVEETQSLLKTSAADFNNQTPQINQAQNLANTLIQELGNNTYEQLSRLLTNDNGTNSKTSAQAINQAVNNLNERAKTLAGGTTNSPAYQATLLALRSVLGLWNSMGYAVICGGYTKSPGECNQKDFHYTDENGNGTTINCGGSTNSNGTHSYNGTNTLKADKNVSLSIEQYEKIHEAYQILSKALKQAGLAPLNSKGEKLEAHVTTSKYGSLRLSCAASGRTFSTAAMGWFRQAPGKERDFVAGIYWTVGSTYYADSAKGRFTISRDNAKNTVYLQMCSLKPEDTAVYYCAARRRGFTLAPTRANEYDYWGQGTQVTVSSHHHHHHEPEA

SEQ ID NO: 149 - protein, 523 aa, Artificial Sequence
  MbNb207c7HopQ C312-C453
QVQLVESGGGLVQTKTTTSVIDTTNDAQNLLTQAQTIVNTLKDYCPILIAKSSSSNGGTNNANTPSWQTAGGGKNSCATFGAEFSAASDMINNAQKIVQETQQLSANQPKNITQPHNLNLNSPSSLTALAQKMLKNAQSQAEILKLANQVESDFNKLSSGHLKDYIGKCDASAISSANMTMQNQKNNWGNGCAGVEETQSLLKTSAADFNNQTPQINQAQNLANTLIQELGNNTYEQLSRLLTNDNGTNSKTSAQAINQAVNNLNERAKTLAGGTTNSPAYQATLLALRSVLGLWNSMGYAVICGGYTKSPCENNQKDFHYTDENGNGTTINCGGSTNSNGTHSYNGTNTLKADKNVSLSIEQYEKIHEAYQILSKALKQAGLAPLNSKGEKLEAHVTTSKYGSLRLSCAASGRTFSTAAMGWFRQAPGKERDFVAGIYWTVGSTYYADSAKCRFTISRDNAKNTVYLQMDSLKPEDTAVYYCAARRRGFTLAPTRANEYDYWGQGTQVTVSSHHHHHHEPEA

SEQ ID NO: 150 - protein, 523 aa, Artificial Sequence
  MbNb207c7HopQ C349-C452
QVQLVESGGGLVQTKTTTSVIDTTNDAQNLLTQAQTIVNTLKDYCPILIAKSSSSNGGTNNANTPSWQTAGGGKNSCATFGAEFSAASDMINNAQKIVQETQQLSANQPKNITQPHNLNLNSPSSLTALAQKMLKNAQSQAEILKLANQVESDFNKLSSGHLKDYIGKCDASAISSANMTMQNQKNNWGNGCAGVEETQSLLKTSAADFNNQTPQINQAQNLANTLIQELGNNTYEQLSRLLTNDNGTNSKTSAQAINQAVNNLNERAKTLAGGTTNSPAYQATLLALRSVLGLWNSMGYAVICGGYTKSPGENNQKDFHYTDENGNGTTINCGGSTNSNGTHSYNGTCTLKADKNVSLSIEQYEKIHEAYQILSKALKQAGLAPLNSKGEKLEAHVTTSKYGSLRLSCAASGRTFSTAAMGWFRQAPGKERDFVAGIYWTVGSTYYADSACGRFTISRDNAKNTVYLQMDSLKPEDTAVYYCAARRRGFTLAPTRANEYDYWGQGTQVTVSSHHHHHHEPEA

SEQ ID NO: 151 - protein, 254 aa, Artificial Sequence
  MbNb207AzurinA8
QVQLVESGGGLVNCSVDIQGNDQMQFNTNAITVNGSLRLSCAASGRTFSTAAMGWFRQAPGKERDFVAGIYWTVGSTYYADSAKGRFTISRDNAKNTVYLQMDSLKPEDTAVYYCAARRRGFTLAPTRANEYDYWGQGTQVTVSSAVNLSHPGNLPKNVMGHNWVLSTAADMQGVVTDGMASGLDKDYLKPDDSRVIAHTKLIGSGEKDSVTFDVSKLKEGEQYMFFCTFPGHSALAKGTLTLKHHHHHHEPEA

SEQ ID NO: 152 - protein, 254 aa, Artificial Sequence
  MbNb207AzurinD9
QVQLVESGGGLVPCSVDIQGNDQMQFNTNAITVNGSLRLSCAASGRTFSTAAMGWFRQAPGKERDFVAGIYWTVGSTYYADSAKGRFTISRDNAKNTVYLQMDSLKPEDTAVYYCAARRRGFTLAPTRANEYDYWGQGTQVTVSSPVNLSHPGNLPKNVMGHNWVLSTAADMQGVVTDGMASGLDKDYLKPDDSRVIAHTKLIGSGEKDSVTFDVSKLKEGEQYMFFCTFPGHSALAKGTLTLKHHHHHHEPEA

SEQ ID NO: 153 - protein, 255 aa, Artificial Sequence
  MbNb207AzurinD10
QVQLVESGGGLVGNCSVDIQGNDQMQFNTNAITVGGSLRLSCAASGRTFSTAAMGWFRQAPGKERDFVAGIYWTVGSTYYADSAKGRFTISRDNAKNTVYLQMDSLKPEDTAVYYCAARRRGFTLAPTRANEYDYWGQGTQVTVSSKVNLSHPGNLPKNVMGHNWVLSTAADMQGVVTDGMASGLDKDYLKPDDSRVIAHTKLIGSGEKDSVTFDVSKLKEGEQYMFFCTFPGHSALAKGTLTLKHHHHHHEPEA

SEQ ID NO: 154 - protein, 255 aa, Artificial Sequence
  MbNb207AzurinD11
QVQLVESGGGLVGECSVDIQGNDQMQFNTNAITVNGSLRLSCAASGRTFSTAAMGWFRQAPGKERDFVAGIYWTVGSTYYADSAKGRFTISRDNAKNTVYLQMDSLKPEDTAVYYCAARRRGFTLAPTRANEYDYWGQGTQVTVSSNVNLSHPGNLPKNVMGHNWVLSTAADMQGVVTDGMASGLDKDYLKPDDSRVIAHTKLIGSGEKDSVTFDVSKLKEGEQYMFFCTFPGHSALAKGTLTLKHHHHHHEPEA

SEQ ID NO: 155 - protein, 255 aa, Artificial Sequence
  MbNb207AzurinG6
QVQLVESGGGLVGCSVDIQGNDQMQFNTNAITVSTSLRLSCAASGRTFSTAAMGWFRQAPGKERDFVAGIYWTVGSTYYADSAKGRFTISRDNAKNTVYLQMDSLKPEDTAVYYCAARRRGFTLAPTRANEYDYWGQGTQVTVSSDGVNLSHPGNLPKNVMGHNWVLSTAADMQGVVTDGMASGLDKDYLKPDDSRVIAHTKLIGSGEKDSVTFDVSKLKEGEQYMFFCTFPGHSALAKGTLTLKHHHHHHEPEA

SEQ ID NO: 156 - protein, 255 aa, Artificial Sequence
  MbNb207AzurinB8
QVQLVESGGGLVGCSVDIQGNDQMQFNTNAITVSRSLRLSCAASGRTFSTAAMGWFRQAPGKERDFVAGIYWTVGSTYYADSAKGRFTISRDNAKNTVYLQMDSLKPEDTAVYYCAARRRGFTLAPTRANEYDYWGQGTQVTVSSTMVNLSHPGNLPKNVMGHNWVLSTAADMQGVVTDGMASGLDKDYLKPDDSRVIAHTKLIGSGEKDSVTFDVSKLKEGEQYMFFCTFPGHSALAKGTLTLKHHHHHHEPEA

SEQ ID NO: 157 - protein, 256 aa, Artificial Sequence
  MbNb207AzurinB2
QVQLVESGGGLVGGCSVDIQGNDQMQFNTNAITVNGSLRLSCAASGRTFSTAAMGWFRQAPGKERDFVAGIYWTVGSTYYADSAKGRFTISRDNAKNTVYLQMDSLKPEDTAVYYCAARRRGFTLAPTRANEYDYWGQGTQVTVSSPPVNLSHPGNLPKNVMGHNWVLSTAADMQGVVTDGMASGLDKDYLKPDDSRVIAHTKLIGSGEKDSVTFDVSKLKEGEQYMFFCTFPGHSALAKGTLTLKHHHHHHEPEA

SEQ ID NO: 158 - protein, 256 aa, Artificial Sequence
  MbNb207AzurinC8
QVQLVESGGGLVRICSVDIQGNDQMQFNTNAITVNGSLRLSCAASGRTFSTAAMGWFRQAPGKERDFVAGIYWTVGSTYYADSAKGRFTISRDNAKNTVYLQMDSLKPEDTAVYYCAARRRGFTLAPTRANEYDYWGQGTQVTVSSNYVNLSHPGNLPKNVMGHNWVLSTAADMQGVVTDGMASGLDKDYLKPDDSRVIAHTKLIGSGEKDSVTFDVSKLKEGEQYMFFCTFPGHSALAKGTLTLKHHHHHHEPEA

SEQ ID NO: 159 - protein, 391 aa, Artificial Sequence
  MbNb207cPP7x2A3 (MP1403_A3)
MQVQLVESGGGLVQATRTLTEIQSTADRQIFEEKVGPLVGRLRLTASLRQNGAKTAYRVNLKLDQADVVDCSTSVCGELPKVRYTQVWSHDVTIVANSTEASRKSLYDLTKSLVATSQVEDLVVNLVPLGRGLGSKTIVLSVGEATRTLTEIQSTADRQIFEEKVGPLVGRLRLTASLRQNGAKTAYRVNLKLDQADVVDCSTSVCGELPKVRYTQVWSHDVTIVANSTEASRKSLYDLTKSLVATSQVEDLVVNLVPLGRRGSKTIVLSGSLRLSCAASGRTFSTAAMGWFRQAPGKERDFVAGIYWTVGSTYYADSAKGRFTISRDNAKNTVYLQMDSLKPEDTAVYYCAARRRGFTLAPTRANEYDYWGQGTQVTVSSHHHHHHEPEA

SEQ ID NO: 160 - protein, 390 aa, Artificial Sequence
  MbNb207cPP7x2D3 (MP1403_D3)
MQVQLVESGGGLVQATRTLTEIQSTADRQIFEEKVGPLVGRLRLTASLRQNGAKTAYRVNLKLDQADVVDCSTSVCGELPKVRYTQVWSHDVTIVANSTGASRKSLYDLTKSLVATSQVEDLVVNLVPLGRRGSKTIVLSVGEATRTLTEIQSTADRQIFEEKAGPLVGRLRLTASLRQNGAKTAYRVNLKLDQADVVDCSTSVCGELPKVRYTQVWSHDVTIVANSTEASRKSLYDLTKSLVATSQVEDLVVSLVPLGRPGSKTIVLSGSLRLSCAASGRTFSTAAMGWFRQAPGKERDFVAGIYWTVGSTYYADSAKGRFTISRDNAKNTVYLQMDSLKPEDTAVYYCAARRRGFTLAPTRANEYDYWGQGTQVTVSSHHHHHHEPEA

SEQ ID NO: 161 - protein, 391 aa, Artificial Sequence
  MbNb207cPP7x2G5 (MP1403_G5)
MQVQLVESGGGLVQATRTLTEIQSTADRQIFEEKVGPLVGRLRLTASLRQNGAKTAYRVNLKLDQADVVDCSTSVCGELPKVRYTQVWSHDVTIVANSTEASRKSLYDLTKSLVATSQVEDLVVNLVPLGRGVGSKIIVLSVGEATRTLTEIQSTADRQIFEEKVGPLVGRLRLTASLRQNGAKTAYRVNLKLDQADVVDCSTSVCGELPKVRYTQVWSHDVTIVANSTEASRKSLYDLTKSLVATSQVEDLVVNLVPLGRLGSKTIVLSGSLRLSCAASGRTFRTAAMGWFRQAPGKERDFVAGIYWTVGSTYYADSAKGRFTISRDNAKNTVYLQMDSLKPEDTAVYYCAARRRGFTLAPTRANEYDYWGQGTQVTVSSHHHHHHEPEA

SEQ ID NO: 162 - protein, 390 aa, Artificial Sequence
  MbNb207cPP7x2E6 (MP1403_E6)
MQVQLVESGGGLVQATRTLTEIQSTADRQIFEEKVGPLVGRLRLTASLRQNGAKTAYRVNLKLDQADVVDCSTSVCGELPKVRYTQVWSHDVTIVANSTEASRKSLYDLTKSLVATSQVEDLVVNLVPLGRWGSKTIVLSVGEATRTLTEIQSTADRQIFEEKVGPLVGRLRLTASLRQNGAKTAYRVNLKLDQADVVDCSTSVCGELPKVRYTQVWSHDVTIVANSTEASRKSLYDLTKSLVATSQVEDLVVNLVPLGRPGSKTIVLSGSLRLSCAASERTFSTAAMGWFRQAPGKERDFVAGIYWTVGSTYYADSAKGRFTISRDNAKNTVYLQMDSLKPEDTAVYYCAARRRGFTLAPTRANEYDYWGQGTQVTVSSHHHHHHEPEA

SEQ ID NO: 163 - protein, 391 aa, Artificial Sequence
  MbNb207cPP7x2D7 (MP1403_D7)
MQVQLVESGGGLVQATRTLTEIQSTADRQIFEEKVGPLVGRLRLTASLRQNGAKTAYRVNLKLDQADVVDCSTSVCGELPKVRYTQVWSHDVTIVANSTEASRKSLYDLTKSLVATSQVEDLVVNLVPLGRRGSKTIVLSVGEATRTLTEIQSTADRQIFEEKVGPLVGRLRLTASLRQNGAKTAYRVNLKLDQADVVDCSTSVCGELPKVRYTQVWSHDVTIVANSTEASRKSLYDLTKSLVATSQVEDLVVNLVPLGRGPGSKTIVLSGSLRLSCAASGRTFSTAAMGWFRQAPGKERDFVAGIYWTVGSTYYADSAKGRFTISRDNAKNTVYLQMDSLKPEDTAVYYCAARRRGFTLAPTRANEYDYWGQGTQVTVSSHHHHHHEPEA

SEQ ID NO: 164 - protein, 391 aa, Artificial Sequence
  MbNb207cPP7x2A9 (MP1403_A9)
MQVQLVESGGGLVQATRTLTEIQSTADRQIFEEKVGPLVGRLRLTASLRQNGAKTAYRVNLKLDQADVVDCSTSVCGELPKVRYTQVWSHDVTIVANSTEASRKSLYDLTQSLVATSQVEDLVVNLVPLGRCRGSKTIVLSVGEATRTLTEIQSTADRQIFEEKVGPLVGRLRLTASLRQNGAKTAYRVNLKLDQADVVDCSTSVCGELPKVRYTQVWSHDVTIVANSTEASRKSLYDLTKSLVATSQVEDLVVNLVPLGRRGSKTIVLSGSLRLSCAASGRTFSTAAMGWFRQAPGKERDFVAGIYWTVGSTYYADSAKGRFTISRDNAKNTVYLQMDSLKPEDTAVYYCAARRRGFTLAPTRANEYDYWGQGTQVTVSSHHHHHHEPEA

SEQ ID NO: 165 - protein, 392 aa, Artificial Sequence
  MbNb207cPP7x2B9 (MP1403_B9)
MQVQLVESGGGLVQATRTLTEIQSTADRLIFEEKVGPLVGRLRLTASLRQNGAKTAYRVNLKLDQADVVDCSTSVCGELPKVRYTQVWSHDVTIVANSTEASRKSLYDLTKSLVATSQVEDLVVNLVPLGRRVGSKTIVLSVGEATRTLTEIQSTADRQIFEEKVGPLVGRLRLTASLRQNGAKTAYRVNLKLDQADVVDCSTSVCGELPKVRYTQVWSHDVTIVANSTEASRKSLYDLTKSLVATSQVEDLVVNLVPLGRPLGSKTIVLSGSLRLSCAASGRTFSTAAMGWFRQAPGKERDFVAGIYWTVGSTYYADSAKGRFTISRDNAKNTVYLQMDSLKPEDTAVYYCAARRRGFTLAPTRANEYDYWGQGTQVTVSSHHHHHHEPEA

SEQ ID NO: 166 - protein, 131 aa, Artificial Sequence
  Covalent dimer
MANKPMQPITSTANKIVWSDPTRLSTTFSASLLRQRVKVGIAELNNVSGQYVSVYKRPAPKPEGCADACVIMPNENQSIRTVISGSAENLATLKAEWETHKRNVDTLFASGNAGLGFLDPTAAIVSSDTTA

SEQ ID NO: 167 - protein, 383 aa, Artificial Sequence
  Chimeric protein
  misc_feature (13)..(13): Xaa can be any naturally occurring amino acid
  misc_feature (262)..(262): Xaa can be any naturally occurring amino acid
MQVQLVESGGGLXKPMQPITSTANKIVWSDPTRLSTTFSASLLRQRVKVGIAELNNVSGQYVSVYKRPAPKPEGCADACVIMPNENQSIRTVISGSAENLATLKAEWETHKRNVDTLFASGNAGLGFLDPTAAIVSSDKPMQPITSTANKIVWSDPTRLSTTFSASLLRQRVKVGIAELNNVSGQYVSVYKRPAPKPEGCADACVIMPNENQSIRTVISGSAENLATLKAEWETHKRNVDTLFASGNAGLGFLDPTAAIVSXGSLRLSCAASGRTFSTAAMGWFRQAPGKERDFVAGIYWTVGSTYYADSAKGRFTISRDNAKNTVYLQMDSLKPEDTAVYYCAARRRGFTLAPTRANEYDYWGQGTQVTVSSHHHHHHEPEA

SEQ ID NO: 168 - protein, 382 aa, Artificial Sequence
  Chimeric protein
MVQLVESGGGLYKPMQPITSTANKIVWSDPTRLSTTFSASLLRQRVKVGIAELNNVSGQYVSVYKRPAPKPEGCADACVIMPNENQSIRTVISGSAENLATLKAEWETHKRNVDTLFASGNAGLGFLDPTAAIVSSDKPMQPITSTANKIVWSDPTRLSTTFSASLLRQRVKVGIAELNNVSGQYVSVYKRPAPKPEGCADACVIMPNENQSIRTVISGSAENLATLKAEWETHKRNVDTLFASGNAGLGFLDPTAAIVSNGSLRLSCAASGRTFSTAAMGWFRQAPGKERDFVAGIYWTVGSTYYADSAKGRFTISRDNAKNTVYLQMDSLKPEDTAVYYCAARRRGFTLAPTRANEYDYWGQGTQVTVSSHHHHHHEPEA

SEQ ID NO: 169 - protein, 383 aa, Artificial Sequence
  Chimeric protein
MQVQLVESGGGLVKPMQPITSTANKIVWSDPTRLSTTFSASLLRQRVKVGIAELNNVSGQYVSVYKRPAPKPEGCADACVIMPNENQSIRTVISGSAENLATLKAEWETHKRNVDTLFASGNAGLGFLDPTAAIVSSDKPMQPITSTANKIVWSDPTRLSTTFSASLLRQRVKVGIAELNNVSGQYVSVYKRPAPKPEGCADACVIMPNENQSIRTVISGSAENLATLKAEWETHKRNVDTLFASGNAGLGFLDPTAAIVSPGSLRLSCAASGRTFSTAAMGWFRQAPGKERDFVAGIYWTVGSTYYADSAKGRFTISRDNAKNTVYLQMDSLKPEDTAVYYCAARRRGFTLAPTRANEYDYWGQGTQVTVSSHHHHHHEPEA

SEQ ID NO: 170 - protein, 383 aa, Artificial Sequence
  Chimeric protein
MQVQLVESGGGLSKPMQPITSTANKIVWSDPTRLSTTFSASLLRQRVKVGIAELNNVSGQYVSVYKRPAPKPEGCADACVIMPNENQSIRTVISGSAENLATLKAEWETHKRNVDTLFASGNAGLGFLDPTAAIVSSDKPMQPITSTANKIVWSDPTRLSTTFSASLLRQRVKVGIAELNNVSGQYVSVYKRPAPKPEGCADACVIMPNENQSIRTVISGSAENLATLKAEWETHKRNVDTLFASGNAGLGFLDPTAAIVSLGSLRLSCAASGRTFSTAAMGWFRQAPGKERDFVAGIYWTVGSTYYADSAKGRFTISRDNAKNTVYLQMDSLKPEDTAVYYCAARRRGFTLAPTRANEYDYWGQGTQVTVSSHHHHHHEPEA

SEQ ID NO: 171 - protein, 383 aa, Artificial Sequence
  Chimeric protein
MQVQLVESGGGLLKPMQPITSTANKIVWSDPTRLSTTFSASLLRQRVKVGIAELNNVSGQYVSVYKRPAPKPEGCADACVIMPNENQSIRTVISGSAENLATLKAEWETHKRNVDTLFASGNAGLGFLDPTAAIVSSDKPMQPITSTANKIVWSDPTRLSTTFSASLLRQRVKVGIAELNNVSGQYVSVYKRPAPKPEGCADACVIMPNENQSIRTVISGSAENLATLKAEWETHKRNVDTLFASGNAGLGFLDPTAAIVSGGSLRLSCAASGRTFSTAAMGWFRQAPGKERDFVAGIYWTVGSTYYADSAKGRFTISRDNAKNTVYLQMDSLKPEDTAVYYCAARRRGFTLAPTRANEYDYWGQGTQVTVSSHHHHHHEPEA

SEQ ID NO: 172 - protein, 383 aa, Artificial Sequence
  Chimeric protein
MQVQLVESGGGLRKPMQPITSTANKIVWSDPTRLSTTFSASLLRQRVKVGIAELNNVSGQYVSVYKRPAPKPEGCADACVIMPNENQSIRTVISGSAENLATLKAEWETHKRNVDTLFASGNAGLGFLDPTAAIVSSDKPMQPITSTANKIVWSDPTRLSTTFSASLLRQRVKVGIAELNNVSGQYVSVYKRPAPKPEGCADACVIMPNENQSIRTVISGSAENLATLKAEWETHKRNVDTLFASGNAGLGFLDPTAAIVSSGSLRLSCAASGRTFSTAAMGWFRQAPGKERDFVAGIYWTVGSTYYADSAKGRFTISRDNAKNTVYLQMDSLKPEDTAVYYCAARRRGFTLAPTRANEYDYWGQGTQVTVSSHHHHHHEPEA

SEQ ID NO: 173 - protein, 258 aa, Artificial Sequence
  Chimeric protein
  misc_feature (13)..(13): Xaa can be any naturally occurring amino acid
  misc_feature (137)..(137): Xaa can be any naturally occurring amino acid
MQVQLVESGGGLXKPMQPITSTANKIVWSDPTRLSTTFSASLLRQRVKVGIAELNNVSGQYVSVYKRPAPKPEGCADACVIMPNENQSIRTVISGSAENLATLKAEWETHKRNVDTLFASGNAGLGFLDPTAAIVSXGSLRLSCAASGRTFSTAAMGWFRQAPGKERDFVAGIYWTVGSTYYADSAKGRFTISRDNAKNTVYLQMDSLKPEDTAVYYCAARRRGFTLAPTRANEYDYWGQGTQVTVSSHHHHHHEPEA

SEQ ID NO: 174 - protein, 258 aa, Artificial Sequence
  Chimeric protein
MQVQLVESGGGLWKPMQPITSTANKIVWSDPTRLSTTFSASLLRQRVKVGIAELNNVSGQYVSVYKRPAPKPEGCADACVIMPNENQSIRTVISGSAENLATLKAEWETHKRNVDTLFASGNAGLGFLDPTAAIVSSGSLRLSCAASGRTFSTAAMGWFRQAPGKERDFVAGIYWTVGSTYYADSAKGRFTISRDNAKNTVYLQMDSLKPEDTAVYYCAARRRGFTLAPTRANEYDYWGQGTQVTVSSHHHHHHEPEA

SEQ ID NO: 175 - protein, 258 aa, Artificial Sequence
  Chimeric protein
MQVQLVESGGGLMKPMQPITSTANKIVWSDPTRLSTTFSASLLRQRVKVGIAELNNVSGQYVSVYKRPAPKPEGCADACVIMPNENQSIRTVISGSAENLATLKAEWETHKRNVDTLFASGNAGLGFLDPTAAIVSGGSLRLSCAASGRTFSTAAMGWFRQAPGKERDFVAGIYWTVGSTYYADSAKGRFTISRDNAKNTVYLQMDSLKPEDTAVYYCAARRRGFTLAPTRANEYDYWGQGTQVTVSSHHHHHHEPEA

SEQ ID NO: 176 - protein, 258 aa, Artificial Sequence
  Chimeric protein
MQVQLVESGGGLRKPMQPITSTANKIVWSDPTRLSTTFSASLLRQRVKVGIAELNNVSGQYVSVYKRPAPKPEGCADACVIMPNENQSIRTVISGSAENLATLKAEWETHKRNVDTLFASGNAGLGFLDPTAAIVSIGSLRLSCAASGRTFSTAAMGWFRQAPGKERDFVAGIYWTVGSTYYADSAKGRFTISRDNAKNTVYLQMDSLKPEDTAVYYCAARRRGFTLAPTRANEYDYWGQGTQVTVSSHHHHHHEPEA

SEQ ID NO: 177 - protein, 258 aa, Artificial Sequence
  Chimeric protein
MQVQLVESGGGLSKPMQPITSTANKIVWSDPTRLSTTFSASLLRQRVKVGIAELNNVSGQYVSVYKRPAPKPEGCADACVIMPNENQSIRTVISGSAENLATLKAEWETHKRNVDTLFASGNAGLGFLDPTAAIVSHGSLRLSCAASGRTFSTAAMGWFRQAPGKERDFVAGIYWTVGSTYYADSAKGRFTISRDNAKNTVYLQMDSLKPEDTAVYYCAARRRGFTLAPTRANEYDYWGQGTQVTVSSHHHHHHEPEA

SEQ ID NO: 178 - protein, 208 aa, Artificial Sequence
  Chimeric protein
QVQLVESGGGLGTIEERVKKIIGEQLGVKQEEVTNNASFVEDLGADSLDTVELVMALEEEFDTEIPDEEAEKITTVQAAIDYINGHQYSLRLSCAASGRTFSTAAMGWFRQAPGKERDFVAGIYWTVGSTYYADSAKGRFTISRDNAKNTVYLQMDSLKPEDTAVYYCAARRRGFTLAPTRANEYDYWGQGTQVTVSSHHHHHHEPEA

SEQ ID NO: 179 - protein, 208 aa, Artificial Sequence
  Chimeric protein
QVQLVESGGGLKTIEERVKKIIGEQLGVKQEEVTNNASFVEDLGADSLDTVELVMALEEEFDTEIPDEEAEKITTVQAAIDYINGHQRSLRLSCAASGRTFSTAAMGWFRQAPGKERDFVAGIYWTVGSTYYADSAKGRFTISRDNAKNTVYLQMDSLKPEDTAVYYCAARRRGFTLAPTRANEYDYWGQGTQVTVSSHHHHHHEPEA

SEQ ID NO: 180 - protein, 209 aa, Artificial Sequence
  Chimeric protein
QVQLVESGGGLRTTIEERVKKIIGEQLGVKQEEVTNNASFVEDLGADSLDTVELVMALEEEFDTEIPDEEAEKITTVQAAIDYINGHQPSLRLSCAASGRTFSTAAMGWFRQAPGKERDFVAGIYWTVGSTYYADSAKGRFTISRDNAKNTVYLQMDSLKPEDTAVYYCAARRRGFTLAPTRANEYDYWGQGTQVTVSSHHHHHHEPEA

SEQ ID NO: 181 - protein, 209 aa, Artificial Sequence
  Chimeric protein
QVQLVESGGGLIFTIEERVKKIIGEQLGVKQEEVTNNASFVEDLGADSLDTVELVMALEEEFDTEIPDEEAEKITTVQAAIDYINGHQSSLRLSCAASGRTFSTAAMGWFRQAPGKERDFVAGIYWTVGSTYYADSAKGRFTISRDNAKNTVYLQMDSLKPEDTAVYYCAARRRGFTLAPTRANEYDYWGQGTQVTVSSHHHHHHEPEA

SEQ ID NO: 182 - protein, 210 aa, Artificial Sequence
  Chimeric protein
QVQLVESGGGLLETIEERVKKIIGEQLGVKQEEVTNNASFVEDLGADSLDTVELVMALEEEFDTEIPDEEAEKITTVQAAIDYINGHQNLSLRLSCAASGRTFSTAAMGWFRQAPGKERDFVAGIYWTVGSTYYADSAKGRFTISRDNAKNTVYLQMDSLKPEDTAVYYCAARRRGFTLAPTRANEYDYWGQGTQVTVSSHHHHHHEPEA

SEQ ID NO: 183 - protein, 210 aa, Artificial Sequence
  Chimeric protein
QVQLVESGGGLWYTIEERVKKIIGEQLGVKQEEVTNNASFVEDLGADSLDTVELVMALEEEFDTEIPDEEAEKITTVQAAIDYINGHQNLSLRLSCAASGRTFSTAAMGWFRQAPGKERDFVAGIYWTVGSTYYADSAKGRFTISRDNAKNTVYLQMDSLKPEDTAVYYCAARRRGFTLAPTRANEYDYWGQGTQVTVSSHHHHHHEPEA

SEQ ID NO: 184 - protein, 271 aa, Artificial Sequence
  Chimeric protein
  misc_feature (132)..(135): Xaa can be any naturally occurring amino acid
QVQLVESGGGLVQTENHQLQESGGGLVQAGGSLRLSCAASGRTFSTAAMGWFRQAPGKERDFVAGIYWTVGSTYYADSAKGRFTISRDNAKNTVYLQMDSLKPEDTAVYYCAARRRGFTLAPTRANEYDYWXXXXGSLRLSCAASGYTYSSNCMAWFRQVPGKEREGVASINTRGGITYYADSVKGRFTISRDNAKNTVSLQMNSLKPEDTATYYCAAVREATYSDNRCSVRSYTYDYWGQGTQVTVSGQEGQGTQVTVSSHHHHHHEPEA

SEQ ID NO: 185 - protein, 271 aa, Artificial Sequence
  Chimeric protein
  misc_feature (132)..(135): Xaa can be any naturally occurring amino acid
QVQLVESGGGLVQTENHQLQESGGGLVQAGGSLRLSCAASGRTFSTAAMGWFRQAPGKERDFVAGIYWTVGSTYYADSAKGRFTISRDNAKNTVYLQMDSLKPEDTAVYYCAARRRGFTLAPTRANEYDYWXXXXGSLRLSCAASGYTYSSNCMAWFRQVPGKEREGVASINTRGGITYYADSVKGRFTISRDNAKNTVSLQMNSLKPEDTATYYCAAVREATYSDNRCSVRSYTYDYWGQGTQVTVSGQQGQGTQVTVSSHHHHHHEPEA

SEQ ID NO: 186 - protein, 271 aa, Artificial Sequence
  Chimeric protein
QVQLVESGGGLVQTENHQLQESGGGLVQAGGSLRLSCAASGRTFSTAAMGWFRQAPGKERDFVAGIYWTVGSTYYADSAKGRFTISRDNAKNTVYLQMDSLKPEDTAVYYCAARRRGFTLAPTRANEYDYWWGSLGSLRLSCAASGYTYSSNCMAWFRQVPGKEREGVASINTRGGITYYADSVKGRFTISRDNAKNTVSLQMNSLKPEDTATYYCAAVREATYSDNRCSVRSYTYDYWGQGTQVTVSGQEGQGTQVTVSSHHHHHHEPEA

SEQ ID NO: 187 - protein, 271 aa, Artificial Sequence
  Chimeric protein
QVQLVESGGGLVQTENHQLQESGGGLVQAGGSLRLSCAASGRTFSTAAMGWFRQAPGKERDFVAGIYWTVGSTYYADSAKGRFTISRDNAKNTVYLQMDSLKPEDTAVYYCAARRRGFTLAPTRANEYDYWGVLLGSLRLSCAASGYTYSSNCMAWFRQVPGKEREGVASINTRGGITYYADSVKGRFTISRDNAKNTVSLQMNSLKPEDTATYYCAAVREATYSDNRCSVRSYTYDYWGQGTQVTVSGQQGQGTQVTVSSHHHHHHEPEA

SEQ ID NO: 188 - protein, 271 aa, Artificial Sequence
  Chimeric protein
QVQLVESGGGLVQTENHQLQESGGGLVQAGGSLRLSCAASGRTFSTAAMGWFRQAPGKERDFVAGIYWTVGSTYYADSAKGRFTISRDNAKNTVYLQMDSLKPEDTAVYYCAARRRGFTLAPTRANEYDYWAQWMGSLRLSCAASGYTYSSNCMAWFRQVPGKEREGVASINTRGGITYYADSVKGRFTISRDNAKNTVSLQMNSLKPEDTATYYCAAVREATYSDNRCSVRSYTYDYWGQGTQVTVSGQQGQGTQVTVSSHHHHHHEPEA

SEQ ID NO: 189 - protein, 271 aa, Artificial Sequence
  Chimeric protein
QVQLVESGGGLVQTENHQLQESGGGLVQAGGSLRLSCAASGRTFSTAAMGWFRQAPGKERDFVAGIYWTVGSTYYADSAKGRFTISRDNAKNTVYLQMDSLKPEDTAVYYCAARRRGFTLAPTRANEYDYWSEVRGSLRLSCAASGYTYSSNCMAWFRQVPGKEREGVASINTRGGITYYADSVKGRFTISRDNAKNTVSLQMNSLKPEDTATYYCAAVREATYSDNRCSVRSYTYDYWGQGTQVTVSGQEGQGTQVTVSSHHHHHHEPEA

SEQ ID NO: 190 - protein, 271 aa, Artificial Sequence
  Chimeric protein
QVQLVESGGGLVQTENHQLQESGGGLVQAGGSLRLSCAASGRTFSTAAMGWFRQAPGKERDFVAGIYWTVGSTYYADSAKGRFTISRDNAKNTVYLQMDSLKPEDTAVYYCAARRRGFTLAPTRANEYDYWRAAAGSLRLSCAASGYTYSSNCMAWFRQVPGKEREGVASINTRGGITYYADSVKGRFTISRDNAKNTVSLQMNSLKPEDTATYYCAAVREATYSDNRCSVRSYTYDYWGQGTQVTVSGQEGQGTQVTVSSHHHHHHEPEA

SEQ ID NO: 191 - protein, 271 aa, Artificial Sequence
  Chimeric protein
QVQLVESGGGLVQTENHQLQESGGGLVQAGGSLRLSCAASGRTFSTAAMGWFRQAPGKERDFVAGIYWTVGSTYYADSAKGRFTISRDNAKNTVYLQMDSLKPEDTAVYYCAARRRGFTLAPTRANEYDYWVEAAGSLRLSCAASGYTYSSNCMAWFRQVPGKEREGVASINTRGGITYYADSVKGRFTISRDNAKNTVSLQMNSLKPEDTATYYCAAVREATYSDNRCSVRSYTYDYWGQGTQVTVSGQQGQGTQVTVSSHHHHHHEPEA

SEQ ID NO: 192 - protein, 70 aa, Mycobacterium tuberculosis
MSNHTYRVIEIVGTSPDGVDAAIQGGLARAAQTMRALDWFEVQSIRGHLVDGAVAHFQVTMKVGFRLEDS

SEQ ID NO: 193 - protein, 195 aa, Artificial Sequence
  MbNb207Dodecinrandomlinkers Megabody
  misc_feature (12)..(12): Xaa can be any naturally occurring amino acid
  misc_feature (75)..(75): Xaa can be any naturally occurring amino acid
QVQLVESGGGLXTYRVIEIVGTSPDGVDAAIQGGLARAAQTMRALDWFEVQSIRGHLVDGAVAHFQVTMKVGFRXSLRLSCAASGRTFSTAAMGWFRQAPGKERDFVAGIYWTVGSTYYADSAKGRFTISRDNAKNTVYLQMDSLKPEDTAVYYCAARRRGFTLAPTRANEYDYWGQGTQVTVSSHHHHHHEPEA

SEQ ID NO: 194 - protein, 911 aa, Artificial Sequence
  Chimeric protein
QVQLVESGGGLVYKEETQSGLNNYARVVEKGQYDSLEIPAQVAASWESGRDDAAVFGFIDKEQLDKYVANGGKRSDWTVKFAENRSQDGTLLGYSLLQESVDQASYMYSDNHYLAEMATILGKPEEAKRYRQLAQQLADYINTCMFDPTTQFYYDVRIEDKPLANGCAGKPIVERGKGPEGWSPLFNGAATQANADAVVKVMLDPKEFNTFVPLGTAALTNPAFGADIYWRGRVWVDQFWFGLKGMERYGYRDDALKLADTFFRHAKGLTADGPIQENYNPLTGAQQGAPNFSWSAAHLYMLYNDFFRKQASGGGSGGGGSGGGGSGNADNYKNVINRTGAPQYMKDYDYDDHQRFNPFFDLGAWHGHLLPDGPNTMGGFPGVALLTEEYINFMASNFDRLTVWQDGKKVDFTLEAYSIPGALVQKLTAKDVQVEMTLRFATPRTSLLETKITSNKPLDLVWDGELLEKLEAKEGKPLSDKTIAGEYPDYQRKISATRDGLKVTFGKVRATWDLLTSGESEYQVHKSLPVQTEINGNRFTSKAHINGSTTLYTTYSHLLTAQEVSKEQMQIRDILARPAFYLTASQQRWEEYLKKGLTNPDATPEQTRVAVKAIETLNGNWRSPGGAVKFNTVTPSVTGRWFSGNQTWPWDTWKQAFAMAHFNPDIAKENIRAVFSWQIQPGDSVRPQDVGFVPDLIAWNLSPERGGDGGNWNERNTKPSLAAWSVMEVYNVTQDKTWVAEMYPKLVAYHDWWLRNRDHNGNGVPEYGATRDKAHNTESGEMLFTVKKDSLRLSCAASGFTFSNYKMNWVRQAPGKGLEWVSDISQSGASISYTGSVKGRFTISRDNAKNTLYLQMNSLKPEDTAVYYCARCPAPFTRDCFDVTSTTYAYRGQGTQVTVSSHHHHHHEPEA

SEQ ID NO: 195 - protein, 903 aa, Artificial Sequence
  Chimeric protein
QVQLVESGGGLVYKEETQSGLNNYARVVEKGQYDSLEIPAQVAASWESGRDDAAVFGFIDKEQLDKYVANGGKRSDWTVKFAENRSQDGTLLGYSLLQESVDQASYMYSDNHYLAEMATILGKPEEAKRYRQLAQQLADYINTCMFDPTTQFYYDVRIEDKPLANGCAGKPIVERGKGPEGWSPLFNGAATQANADAVVKVMLDPKEFNTFVPLGTAALTNPAFGADIYWRGRVWVDQFWFGLKGMERYGYRDDALKLADTFFRHAKGLTADGPIQENYNPLTGAQQGAPNFSWSAAHLYMLYNDFFRKQASGGGSGGGGSGGGGSGNADNYKNVINRTGAPQYMKDYDYDDHQRFNPFFDLGAWHGHLLPDGPNTMGGFPGVALLTEEYINFMASNFDRLTVWQDGKKVDFTLEAYSIPGALVQKLTAKDVQVEMTLRFATPRTSLLETKITSNKPLDLVWDGELLEKLEAKEGKPLSDKTIAGEYPDYQRKISATRDGLKVTFGKVRATWDLLTSGESEYQVHKSLPVQTEINGNRFTSKAHINGSTTLYTTYSHLLTAQEVSKEQMQIRDILARPAFYLTASQQRWEEYLKKGLTNPDATPEQTRVAVKAIETLNGNWRSPGGAVKFNTVTPSVTGRWFSGNQTWPWDTWKQAFAMAHFNPDIAKENIRAVFSWQIQPGDSVRPQDVGFVPDLIAWNLSPERGGDGGNWNERNTKPSLAAWSVMEVYNVTQDKTWVAEMYPKLVAYHDWWLRNRDHNGNGVPEYGATRDKAHNTESGEMLFTVKKDSLRLSCAASGSIFSINTMGWYRQAPGKQRELVAAIHSGGSTNYANSVKGRFTISRDNAANTVYLQMNSLKPEDTAVYYCNVKDYGAVLYEYDYWGQGTQVTVSSHHHHHHEPEA

SEQ ID NO: 196 - protein, 908 aa, Artificial Sequence
  Chimeric protein
QVQLVESGGGLVYKEETQSGLNNYARVVEKGQYDSLEIPAQVAASWESGRDDAAVFGFIDKEQLDKYVANGGKRSDWTVKFAENRSQDGTLLGYSLLQESVDQASYMYSDNHYLAEMATILGKPEEAKRYRQLAQQLADYINTCMFDPTTQFYYDVRIEDKPLANGCAGKPIVERGKGPEGWSPLFNGAATQANADAVVKVMLDPKEFNTFVPLGTAALTNPAFGADIYWRGRVWVDQFWFGLKGMERYGYRDDALKLADTFFRHAKGLTADGPIQENYNPLTGAQQGAPNFSWSAAHLYMLYNDFFRKQASGGGSGGGGSGGGGSGNADNYKNVINRTGAPQYMKDYDYDDHQRFNPFFDLGAWHGHLLPDGPNTMGGFPGVALLTEEYINFMASNFDRLTVWQDGKKVDFTLEAYSIPGALVQKLTAKDVQVEMTLRFATPRTSLLETKITSNKPLDLVWDGELLEKLEAKEGKPLSDKTIAGEYPDYQRKISATRDGLKVTFGKVRATWDLLTSGESEYQVHKSLPVQTEINGNRFTSKAHINGSTTLYTTYSHLLTAQEVSKEQMQIRDILARPAFYLTASQQRWEEYLKKGLTNPDATPEQTRVAVKAIETLNGNWRSPGGAVKFNTVTPSVTGRWFSGNQTWPWDTWKQAFAMAHFNPDIAKENIRAVFSWQIQPGDSVRPQDVGFVPDLIAWNLSPERGGDGGNWNERNTKPSLAAWSVMEVYNVTQDKTWVAEMYPKLVAYHDWWLRNRDHNGNGVPEYGATRDKAHNTESGEMLFTVKKDSLRLSCAASGHTFNYPIMGWFRQAPGKEREFVGAISWSGGSTSYADSVKDRFTISRDNAKNTVYLEMNNLKPEDTAVYYCAAKGRYSGGLYYPTNYDYWGQGTQVTVSSHHHHHHEPEA

SEQ ID NO: 197 - protein, 906 aa, Artificial Sequence
  Chimeric protein
QVQLVESGGGLVYKEETQSGLNNYARVVEKGQYDSLEIPAQVAASWESGRDDAAVFGFIDKEQLDKYVANGGKRSDWTVKFAENRSQDGTLLGYSLLQESVDQASYMYSDNHYLAEMATILGKPEEAKRYRQLAQQLADYINTCMFDPTTQFYYDVRIEDKPLANGCAGKPIVERGKGPEGWSPLFNGAATQANADAVVKVMLDPKEFNTFVPLGTAALTNPAFGADIYWRGRVWVDQFWFGLKGMERYGYRDDALKLADTFFRHAKGLTADGPIQENYNPLTGAQQGAPNFSWSAAHLYMLYNDFFRKQASGGGSGGGGSGGGGSGNADNYKNVINRTGAPQYMKDYDYDDHQRFNPFFDLGAWHGHLLPDGPNTMGGFPGVALLTEEYINFMASNFDRLTVWQDGKKVDFTLEAYSIPGALVQKLTAKDVQVEMTLRFATPRTSLLETKITSNKPLDLVWDGELLEKLEAKEGKPLSDKTIAGEYPDYQRKISATRDGLKVTFGKVRATWDLLTSGESEYQVHKSLPVQTEINGNRFTSKAHINGSTTLYTTYSHLLTAQEVSKEQMQIRDILARPAFYLTASQQRWEEYLKKGLTNPDATPEQTRVAVKAIETLNGNWRSPGGAVKFNTVTPSVTGRWFSGNQTWPWDTWKQAFAMAHFNPDIAKENIRAVFSWQIQPGDSVRPQDVGFVPDLIAWNLSPERGGDGGNWNERNTKPSLAAWSVMEVYNVTQDKTWVAEMYPKLVAYHDWWLRNRDHNGNGVPEYGATRDKAHNTESGEMLFTVKKDSLRLSCAASGRTFTTYIMAWFRQAPGKEREFLAAMDQGRIQYYGDSVRGRFTISRDYAKNSVDLQLDGLRPEDTAVYYCAAGAGFWGLRTASSYHYWGQGTQVTVSSHHHHHHEPEA

SEQ ID NO: 198 - protein, 124 aa, Artificial Sequence
  Nb22 Tropomyosin-Related Kinase receptor B (TrkB)-specific Nanobody
QVQLVESGGGLVQPGGSLRLSCTASGFTFDNYAIGWFRQAPGKEREGVSCISRSGRSTYYADSVKGRVTIAKEKNTVLLQMNDLQPDDTAVYYCAAGTVTVVGSACPSTARRLWGRGTQVTVSS

SEQ ID NO: 199 - protein, 907 aa, Artificial Sequence
  Chimeric protein
QVQLVESGGGLVYKEETQSGLNNYARVVEKGQYDSLEIPAQVAASWESGRDDAAVFGFIDKEQLDKYVANGGKRSDWTVKFAENRSQDGTLLGYSLLQESVDQASYMYSDNHYLAEMATILGKPEEAKRYRQLAQQLADYINTCMFDPTTQFYYDVRIEDKPLANGCAGKPIVERGKGPEGWSPLFNGAATQANADAVVKVMLDPKEFNTFVPLGTAALTNPAFGADIYWRGRVWVDQFWFGLKGMERYGYRDDALKLADTFFRHAKGLTADGPIQENYNPLTGAQQGAPNFSWSAAHLYMLYNDFFRKQASGGGSGGGGSGGGGSGNADNYKNVINRTGAPQYMKDYDYDDHQRFNPFFDLGAWHGHLLPDGPNTMGGFPGVALLTEEYINFMASNFDRLTVWQDGKKVDFTLEAYSIPGALVQKLTAKDVQVEMTLRFATPRTSLLETKITSNKPLDLVWDGELLEKLEAKEGKPLSDKTIAGEYPDYQRKISATRDGLKVTFGKVRATWDLLTSGESEYQVHKSLPVQTEINGNRFTSKAHINGSTTLYTTYSHLLTAQEVSKEQMQIRDILARPAFYLTASQQRWEEYLKKGLTNPDATPEQTRVAVKAIETLNGNWRSPGGAVKFNTVTPSVTGRWFSGNQTWPWDTWKQAFAMAHFNPDIAKENIRAVFSWQIQPGDSVRPQDVGFVPDLIAWNLSPERGGDGGNWNERNTKPSLAAWSVMEVYNVTQDKTWVAEMYPKLVAYHDWWLRNRDHNGNGVPEYGATRDKAHNTESGEMLFTVKKDSLRLSCTASGFTFDNYAIGWFRQAPGKEREGVSCISRSGRSTYYADSVKGRVTIAKEKNTVLLQMNDLQPDDTAVYYCAAGTVTVVGSACPSTARRLWGRGTQVTVSSHHHHHHEPEA

SEQ ID NO: 200 - protein, 125 aa, Burkholderia cenocepacia
MHHHHHHMQVQDLTGAALDYWVATAEGHEVPRADASGCTSIREPGGVPTPFAPSSSWADGGPIVERLPFAGFERDGGRGAWRAVLHRAVPAAGERCTFNQSGPTLLIAAMRTLVASTFGDDVPDL

SEQ ID NO: 201 - protein, 249 aa, Artificial Sequence
  MbNb2074QYBrandomlinkers
  misc_feature (13)..(13): Xaa can be any naturally occurring amino acid
  misc_feature (128)..(128): Xaa can be any naturally occurring amino acid
QVQLVESGGGLVXMQVQDLTGAALDYWVATAEGHEVPRADASGCTSIREPGGVPTPFAPSSSWADGGPIVERLPFAGFERDGGRGAWRAVLHRAVPAAGERCTFNQSGPTLLIAAMRTLVASTFGDDXGSLRLSCAASGRTFSTAAMGWFRQAPGKERDFVAGIYWTVGSTYYADSAKGRFTISRDNAKNTVYLQMDSLKPEDTAVYYCAARRRGFTLAPTRANEYDYWGQGTQVTVSSHHHHHHEPEA

SEQ ID NO: 202 - protein, 251 aa, Artificial Sequence
  MbNb2074QYBrandomlinkers
  misc_feature (13)..(14): Xaa can be any naturally occurring amino acid
  misc_feature (129)..(130): Xaa can be any naturally occurring amino acid
QVQLVESGGGLVXXMQVQDLTGAALDYWVATAEGHEVPRADASGCTSIREPGGVPTPFAPSSSWADGGPIVERLPFAGFERDGGRGAWRAVLHRAVPAAGERCTFNQSGPTLLIAAMRTLVASTFGDDXXGSLRLSCAASGRTFSTAAMGWFRQAPGKERDFVAGIYWTVGSTYYADSAKGRFTISRDNAKNTVYLQMDSLKPEDTAVYYCAARRRGFTLAPTRANEYDYWGQGTQVTVSSHHHHHHEPEA

SEQ ID NO: 203 - protein, 250 aa, Artificial Sequence
  MbNb2074QYBrandomlinkers
  misc_feature (13)..(14): Xaa can be any naturally occurring amino acid
  misc_feature (129)..(129): Xaa can be any naturally occurring amino acid
QVQLVESGGGLVXXMQVQDLTGAALDYWVATAEGHEVPRADASGCTSIREPGGVPTPFAPSSSWADGGPIVERLPFAGFERDGGRGAWRAVLHRAVPAAGERCTFNQSGPTLLIAAMRTLVASTFGDDXGSLRLSCAASGRTFSTAAMGWFRQAPGKERDFVAGIYWTVGSTYYADSAKGRFTISRDNAKNTVYLQMDSLKPEDTAVYYCAARRRGFTLAPTRANEYDYWGQGTQVTVSSHHHHHHEPEA

SEQ ID NO: 204 - protein, 250 aa, Artificial Sequence
  MbNb2074QYBrandomlinkers
  misc_feature (13)..(13): Xaa can be any naturally occurring amino acid
  misc_feature (128)..(129): Xaa can be any naturally occurring amino acid
QVQLVESGGGLVXMQVQDLTGAALDYWVATAEGHEVPRADASGCTSIREPGGVPTPFAPSSSWADGGPIVERLPFAGFERDGGRGAWRAVLHRAVPAAGERCTFNQSGPTLLIAAMRTLVASTFGDDXXGSLRLSCAASGRTFSTAAMGWFRQAPGKERDFVAGIYWTVGSTYYADSAKGRFTISRDNAKNTVYLQMDSLKPEDTAVYYCAARRRGFTLAPTRANEYDYWGQGTQVTVSSHHHHHHEPEA

SEQ ID NO: 205 - protein, 271 aa, Artificial Sequence
  PelB_MbNb2074QYBrandomlinkers
  misc_feature (35)..(35): Xaa can be any naturally occurring amino acid
  misc_feature (150)..(150): Xaa can be any naturally occurring amino acid
MKYLLPTAAAGLLLLAAQPAMAQVQLVESGGGLVXMQVQDLTGAALDYWVATAEGHEVPRADASGCTSIREPGGVPTPFAPSSSWADGGPIVERLPFAGFERDGGRGAWRAVLHRAVPAAGERCTFNQSGPTLLIAAMRTLVASTFGDDXGSLRLSCAASGRTFSTAAMGWFRQAPGKERDFVAGIYWTVGSTYYADSAKGRFTISRDNAKNTVYLQMDSLKPEDTAVYYCAARRRGFTLAPTRANEYDYWGQGTQVTVSSHHHHHHEPEA

SEQ ID NO: 206 - protein, 273 aa, Artificial Sequence
  PelB_MbNb2074QYBrandomlinkers
  misc_feature (35)..(36): Xaa can be any naturally occurring amino acid
  misc_feature (151)..(152): Xaa can be any naturally occurring amino acid
MKYLLPTAAAGLLLLAAQPAMAQVQLVESGGGLVXXMQVQDLTGAALDYWVATAEGHEVPRADASGCTSIREPGGVPTPFAPSSSWADGGPIVERLPFAGFERDGGRGAWRAVLHRAVPAAGERCTFNQSGPTLLIAAMRTLVASTFGDDXXGSLRLSCAASGRTFSTAAMGWFRQAPGKERDFVAGIYWTVGSTYYADSAKGRFTISRDNAKNTVYLQMDSLKPEDTAVYYCAARRRGFTLAPTRANEYDYWGQGTQVTVSSHHHHHHEPEA

SEQ ID NO: 207 - protein, 272 aa, Artificial Sequence
  PelB_MbNb2074QYBrandomlinkers
  misc_feature (35)..(36): Xaa can be any naturally occurring amino acid
  misc_feature (151)..(151): Xaa can be any naturally occurring amino acid
MKYLLPTAAAGLLLLAAQPAMAQVQLVESGGGLVXXMQVQDLTGAALDYWVATAEGHEVPRADASGCTSIREPGGVPTPFAPSSSWADGGPIVERLPFAGFERDGGRGAWRAVLHRAVPAAGERCTFNQSGPTLLIAAMRTLVASTFGDDXGSLRLSCAASGRTFSTAAMGWFRQAPGKERDFVAGIYWTVGSTYYADSAKGRFTISRDNAKNTVYLQMDSLKPEDTAVYYCAARRRGFTLAPTRANEYDYWGQGTQVTVSSHHHHHHEPEA

SEQ ID NO: 208 - protein, 272 aa, Artificial Sequence
  PelB_MbNb2074QYBrandomlinkers
  misc_feature (35)..(35): Xaa can be any naturally occurring amino acid
  misc_feature (150)..(151): Xaa can be any naturally occurring amino acid
MKYLLPTAAAGLLLLAAQPAMAQVQLVESGGGLVXMQVQDLTGAALDYWVATAEGHEVPRADASGCTSIREPGGVPTPFAPSSSWADGGPIVERLPFAGFERDGGRGAWRAVLHRAVPAAGERCTFNQSGPTLLIAAMRTLVASTFGDDXXGSLRLSCAASGRTFSTAAMGWFRQAPGKERDFVAGIYWTVGSTYYADSAKGRFTISRDNAKNTVYLQMDSLKPEDTAVYYCAARRRGFTLAPTRANEYDYWGQGTQVTVSSHHHHHHEPEA

SEQ ID NO: 209 - protein, 4 aa, Artificial Sequence
  affinity tag
EPEA

SEQ ID NO: 210 - protein, 6 aa, Artificial Sequence
  antigenbinding chimeric protein
  misc_feature (3)..(4): Xaa can be any naturally occurring amino acid
LVXXKT

SEQ ID NO: 211 - protein, 6 aa, Artificial Sequence
  antigen-binding chimeric protein
  misc_feature (3)..(4): Xaa can be any naturally occurring amino acid
SKXXSL

SEQ ID NO: 212 - protein, 5 aa, Artificial Sequence
  antigen-binding chimeric protein
  misc_feature (3)..(3): Xaa can be any naturally occurring amino acid
SKXSL

SEQ ID NO: 213 - protein, 5 aa, Artificial Sequence
  antigen-binding chimeric protein
  misc_feature (3)..(3): Xaa can be any naturally occurring amino acid
LVXKT

SEQ ID NO: 214 - protein, 4 aa, Artificial Sequence
  linker peptide
TENH

SEQ ID NO: 215 - protein, 4 aa, Artificial Sequence
  linker peptide
WGSL

SEQ ID NO: 216 - protein, 4 aa, Artificial Sequence
  linker peptide
GVLL

SEQ ID NO: 217 - protein, 4 aa, Artificial Sequence
  linker peptide
AQWM

SEQ ID NO: 218 - protein, 4 aa, Artificial Sequence
  linker peptide
SEVR

SEQ ID NO: 219 - protein, 4 aa, Artificial Sequence
  linker peptide
RAAA

SEQ ID NO: 220 - protein, 4 aa, Artificial Sequence
  linker peptide
VEAA

The invention claimed is:

1. An antigen-binding chimeric protein comprising an antigen-binding domain of an immunoglobulin fused with a scaffold protein, wherein the scaffold protein interrupts the primary topology of the antigen-binding domain at one or more exposed regions comprising a loop or β-turn of the antigen-binding domain, wherein said one or more exposed regions are not in complementarity-determining regions, wherein the antigen-binding domain retains the antigen-binding capacity, and wherein the scaffold protein is fused to the antigen-binding domain via at least two direct fusions or fusions made by a linker.

2. The antigen-binding chimeric protein of claim 1, wherein the antigen-binding domain comprises at least 7 anti-parallel β-strands and at least three R turns, wherein the β-strands and βturns are defined according to IMGT nomenclature.

3. The antigen-binding chimeric protein of claim 1, wherein the antigen-binding domain comprises an immunoglobulin (Ig) domain.

4. The antigen-binding domain of claim 1, wherein the scaffold protein is inserted:

in the first β-turn that connects β-strand A and B of the antigen-binding domain; or in the β-turn that connects β-strand C and C' of the antigen-binding domain; or in the β-turn that connects β-strand C" and D of the antigen-binding domain; or in the β-turn that connects β-strand D and E of the antigen-binding domain; or in the β-turn that connects β-strand E and F of the antigen-binding domain, and wherein the β-strands are defined according to IMGT nomenclature.

5. The antigen-binding chimeric protein of claim 1, wherein the scaffold protein is a circularly permutated protein.

6. The antigen-binding chimeric protein of claim 1, wherein the scaffold protein is a protein with symmetry, a multimeric scaffold having symmetry, or a protein forming virus-like particles.

7. The antigen-binding chimeric protein of claim 6, wherein each of the monomers of the multimer is connected to said antigen-binding domain.

8. The antigen-binding chimeric protein of claim 1, wherein the antigen-binding domain and the scaffold are connected via a disulphide bond.

9. The antigen-binding chimeric protein of claim 1, wherein the scaffold protein has a total molecular mass of at least 30 kDa.

10. The antigen-binding chimeric protein of claim 1, wherein the scaffold protein comprises an additional antigen-binding domain.

11. The antigen-binding chimeric protein of claim 1, wherein the scaffold protein is a labelled protein.

12. The antigen-binding chimeric protein of claim 1, wherein the antigen-binding chimeric protein is comprised in a cell.

13. The antigen-binding chimeric protein of claim 12, wherein the cell further comprises the target antigen of the antigen-binding chimeric protein.

14. A complex comprising
(i) the antigen-binding chimeric protein of claim 1, and
(ii) a target protein,
wherein the target protein is specifically bound to the antigen-binding chimeric protein.

15. A composition comprising the antigen-binding chimeric protein of claim 1.

16. A composition comprising a first and a second antigen-binding chimeric protein, wherein each of the first and the second antigen-binding proteins are antigen binding proteins of claim 1, wherein the antigen-binding domain of the second antigen-binding chimeric protein specifically binds the scaffold protein of the first antigen-binding chimeric protein.

17. The antigen-binding chimeric protein of claim 1, wherein the antigen-binding chimeric protein is comprised in a virus-like particle.

18. A nucleic acid molecule encoding the antigen-binding chimeric protein of claim 1.

19. The nucleic acid molecule of claim 18, wherein the nucleic acid molecule is comprised in a vector.

20. The nucleic acid molecule of claim 19, wherein the vector is a vector for surface display in yeast, phages, bacteria, or viruses.

21. A method of determining a 3-dimensional structure of a target protein, the method comprising:
Providing the complex of claim 14;
displaying the complex in suitable conditions for structural analysis, and
determining the 3D structure of the target protein;
wherein the 3D structure of the target protein is determined at high-resolution.

22. The method according to claim 21, wherein determining the 3D structure of the target protein comprises single particle cryo-EM or crystallography.

* * * * *